United States Patent
Zhang et al.

(10) Patent No.: US 11,384,344 B2
(45) Date of Patent: Jul. 12, 2022

(54) CRISPR-ASSOCIATED TRANSPOSASE SYSTEMS AND METHODS OF USE THEREOF

(71) Applicants: THE BROAD INSTITUTE, INC., Cambridge, MA (US); MASSACHUSETTS INSTITUTE OF TECHNOLOGY, Cambridge, MA (US)

(72) Inventors: Feng Zhang, Cambridge, MA (US); Jonathan Strecker, Cambridge, MA (US); Alim Ladha, Cambridge, MA (US)

(73) Assignees: THE BROAD INSTITUTE, INC., Cambridge, MA (US); MASSACHUSETTS INSTITUTE OF TECHNOLOGY, Cambridge, MA (US)

( * ) Notice: Subject to any disclaimer, the term of this patent is extended or adjusted under 35 U.S.C. 154(b) by 0 days.

(21) Appl. No.: 16/717,713

(22) Filed: Dec. 17, 2019

(65) Prior Publication Data
US 2020/0190487 A1    Jun. 18, 2020

Related U.S. Application Data

(60) Provisional application No. 62/914,471, filed on Oct. 12, 2019, provisional application No. 62/904,548, filed on Sep. 23, 2019, provisional application No. 62/871,683, filed on Jul. 8, 2019, provisional application No. 62/862,531, filed on Jun. 17, 2019, provisional application No. 62/855,763, filed on May 31, 2019, provisional application No. 62/852,922, filed on May 24, 2019, provisional application No. 62/844,685, filed on May 7, 2019, provisional application No. 62/837,695, filed on Apr. 23, 2019, provisional application No. 62/830,059, filed on Apr. 5, 2019, provisional application No. 62/820,639, filed on Mar. 19, 2019, provisional application No. 62/783,878, filed on Dec. 21, 2018, provisional application No. 62/780,658, filed on Dec. 17, 2018.

(51) Int. Cl.
| | |
|---|---|
| *C12N 9/12* | (2006.01) |
| *C12N 9/22* | (2006.01) |
| *C12N 15/11* | (2006.01) |
| *C12N 15/70* | (2006.01) |
| *C12N 15/85* | (2006.01) |

(52) U.S. Cl.
CPC ............. *C12N 9/1241* (2013.01); *C12N 9/22* (2013.01); *C12N 15/11* (2013.01); *C12N 15/70* (2013.01); *C12N 15/85* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | | |
|---|---|---|---|
| 8,440,431 B2 | 5/2013 | Voytas et al. | |
| 8,440,432 B2 | 5/2013 | Voytas et al. | |
| 8,450,471 B2 | 5/2013 | Voytas et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,790,490 B2 | 10/2017 | Zhang et al. | |
| 2011/0265198 A1 | 10/2011 | Gregory et al. | |
| 2012/0017290 A1 | 1/2012 | Cui et al. | |
| 2013/0236946 A1 | 9/2013 | Gouble | |
| 2014/0068797 A1* | 3/2014 | Doudna | C12N 15/90 800/18 |
| 2014/0170753 A1 | 6/2014 | Zhang | |
| 2014/0179006 A1 | 6/2014 | Zhang | |
| 2014/0179770 A1 | 6/2014 | Zhang et al. | |
| 2014/0186843 A1 | 7/2014 | Zhang et al. | |
| 2014/0186919 A1 | 7/2014 | Zhang et al. | |
| 2014/0186958 A1 | 7/2014 | Zhang et al. | |
| 2014/0189896 A1 | 7/2014 | Zhang et al. | |

(Continued)

FOREIGN PATENT DOCUMENTS

| | | |
|---|---|---|
| CN | 105646719 A | 6/2016 |
| EP | 2764103 A2 | 8/2014 |

(Continued)

OTHER PUBLICATIONS

Yamano et al., "Crystal Structure of Cpf1 in Complex with Guide RNA and Target DNA" 165 Cell 949-962 (May 5, 2016).*

(Continued)

*Primary Examiner* — Nancy J Leith

(74) *Attorney, Agent, or Firm* — Johnson, Marcou, Isaacs & Nix, LLC; F. Brent Nix, Esq.; Rachel D. Rutledge, Esq.

(57) ABSTRACT

The present application provides systems, methods and compositions used for targeted gene modification, targeted insertion, perturbation of gene transcripts, nucleic acid editing. Novel nucleic acid targeting systems comprise components of Clustered Regularly Interspaced Short Palindromic Repeats (CRISPR) systems and transposable elements.

22 Claims, 88 Drawing Sheets

Specification includes a Sequence Listing.

(56) References Cited

U.S. PATENT DOCUMENTS

| | | |
|---|---|---|
| 2014/0227787 A1 | 8/2014 | Zhang |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273231 A1 | 9/2014 | Zhang et al. |
| 2014/0273232 A1 | 9/2014 | Zhang et al. |
| 2014/0273234 A1 | 9/2014 | Zhang et al. |
| 2014/0287938 A1 | 9/2014 | Zhang et al. |
| 2014/0310830 A1 | 10/2014 | Zhang et al. |
| 2015/0184139 A1 | 7/2015 | Zhang et al. |
| 2018/0179553 A1 | 6/2018 | Watson et al. |

FOREIGN PATENT DOCUMENTS

| | | |
|---|---|---|
| EP | 2771468 A1 | 9/2014 |
| EP | 2784162 A1 | 10/2014 |
| EP | 3009511 A2 | 4/2016 |
| WO | 2014018423 A2 | 1/2014 |
| WO | 2014093595 A1 | 6/2014 |
| WO | 2014093622 A2 | 6/2014 |
| WO | 2014093635 A1 | 6/2014 |
| WO | 2014093655 A2 | 6/2014 |
| WO | 2014093661 A2 | 6/2014 |
| WO | 2014093694 A1 | 6/2014 |
| WO | 2014093701 A1 | 6/2014 |
| WO | 2014093709 A1 | 6/2014 |
| WO | 2014093712 A1 | 6/2014 |
| WO | 2014093718 A1 | 6/2014 |
| WO | 2014204723 A1 | 12/2014 |
| WO | 2014204724 A1 | 12/2014 |
| WO | 2014204725 A1 | 12/2014 |
| WO | 2014204726 A1 | 12/2014 |
| WO | 2014204727 A1 | 12/2014 |
| WO | 2014204728 A1 | 12/2014 |
| WO | 2014204729 A1 | 12/2014 |
| WO | 2015065964 A1 | 5/2015 |
| WO | 2015089351 A1 | 6/2015 |
| WO | 2015089354 A1 | 6/2015 |
| WO | 2015089364 A1 | 6/2015 |
| WO | 2015089419 A2 | 6/2015 |
| WO | 2015089427 A1 | 6/2015 |
| WO | 2015089462 A1 | 6/2015 |
| WO | 2015089465 A1 | 6/2015 |
| WO | 2015089473 A1 | 6/2015 |
| WO | 2015089486 A2 | 6/2015 |
| WO | 2016028682 A1 | 2/2016 |
| WO | 2016049163 A2 | 3/2016 |
| WO | 2016049258 A2 | 3/2016 |
| WO | 2016161207 A1 | 10/2016 |
| WO | 2018175872 A1 | 9/2018 |
| WO | 2019090173 A1 | 5/2019 |
| WO | 2019090174 A1 | 5/2019 |
| WO | 2019090175 A1 | 5/2019 |

OTHER PUBLICATIONS

Peters et al., "Tn7 recognizes transposition target structures associated with DNA replication using the DNA-binding protein TnsE" 15 Genes & Development 737-747 (2001).*
Strecker, J., et al., "RNA-guided DNA Insertion with CRISPR-associated Transposases," Science, vol. 365, No. 6448, Jul. 5, 2019, all enclosed pages cited.
International Search Report and Written Opinion for co-pending International Application No. PCT/US2019/066835 dated Apr. 24, 2020, all enclosed pages cited.
Abudayyeh, et al., "C2c2 is a Single-Component Programmable RNA-Guided RNA-Targeting CRISPR Effector", Science, vol. 353, No. 6299, Aug. 5, 2016, 11 pages.

Bainton, et al., "Tn7 Transposition in Vitro Proceeds Through an Excised Transposon Intermediate Generated by Staggered Breaks in DNA", Cell, vol. 65, Issue 5, May 31, 1991, 805-816.
Bainton, et al., "Tn7 Transposition: Target DNA Recognition is Mediated by Multiple Tn7-Encoded Proteins in a Purified in Vitro System", Cell, vol. 72, No. 6, Mar. 26, 1993, 931-943.
Barabas, et al., "Mechanism of IS200/IS605 Family DNA Transposases: Activation and Transposon-Directed Target Site Selection", Cell, vol. 132, No. 2, Jan. 25, 2008, 208-220.
Barrangou, et al., "A Decade of Discovery: CRISPR Functions and Applications", Nature Microbiology, vol. 2, Article No. 17092, 2017, 9 pages.
Canver, et al., "BCL11A Enhancer Dissection by Cas9-mediated in Situ Saturating Mutagenesis", Nature, vol. 527, No. 7577, Nov. 12, 2015, 192-197.
Cermak, et al., "Efficient design and assembly of custom TALEN and other TAL effector-based constructs for DNA targeting", Nucleic Acids Research, vol. 39, No. 12, e82, Jul. 2011, 11 pages.
Chen, et al., "Dynamic Imaging of Genomic Loci In Living Human Cells by an Optimized CRJSPR/Cas System", Cell, vol. 155, Dec. 19, 2013, 1479-1491.
Chen, et al., "Genome-Wide CRISPR Screen in a Mouse Model of Tumor Growth and Metastasis", Cell, vol. 160, No. 6, Mar. 12, 2015, 1246-1260.
Cong, et al., "Multiplex Genome Engineering Using CRISPR/Cas Systems", Science, vol. 339, No. 6121, Feb. 15, 2013, 819-823.
Doench, et al., "Rational Design of Highly Active SgRNAs for CRISPR-Cas9-Mediated Gene Inactivation", Nature Biotechnology, vol. 32, No. 12, Dec. 2014, 1262-1267.
Faure, et al., "CRISPR-Cas in Mobile Genetic Elements: Counter-Defence and Beyond", Nature Reviews Microbiology, vol. 17, No. 8, Aug. 2019, 513-525.
Gao, et al., "Engineered Cpf1 Enzymes with Altered PAM Specificities", Nature Biotechnology, vol. 35, No. 8, Dec. 4, 2016, 1-17.
Gaudelli, et al., "Programmable Base Editing of A•T to G•C in Genomic DNA without DNA Cleavage", Nature, vol. 551, No. 7681, Nov. 23, 2017, 464-471.
Hou, et al., "CRISPR-Cas Systems in Multicellular Cyanobacteria", RNA Biology, vol. 16, No. 4, Apr. 2019, 518-529.
Hsu, et al., "Development and Applications of CRISPR-Cas9 for Genome Engineering", Cell, vol. 157, No. 6, Jun. 5, 2014, 1262-1278.
Hsu, et al., "DNA Targeting Specificity of RNA-Guided Cas9 Nucleases", Nature Biotechnology, vol. 31, No. 9, Sep. 2013, 827-832.
Jasin, et al., "Repair of Strand Breaks by Homologous Recombination", Cold Spring Harbor Perspectives in Biology, vol. 5, No. 11, Nov. 2013.
Jiang, et al., "RNA-Guided Editing of Bacterial Genomes Using CRISPR-Cas Systems", Nature Biotechnology, vol. 31, No. 3, Mar. 2013, 233-239.
Klompe, et al., "Transposon-encoded CRISPR-Cas Systems Direct RNA-guided DNA Integration", Nature, Jun. 12, 2019, 28.
Komor, et al., "Programmable Editing of a Target Base in Genomic DNA without Double-Stranded DNA Cleavage", Nature, vol. 533, No. 7603, May 19, 2016, 420-424.
Konermann, et al., "Genome-Scale Transcriptional Activation by an Engineered CRISPR-Cas9 Complex", Nature, vol. 517, No. 7536, Jan. 29, 2015, 583-588.
Konermann, et al., "Optical Control of Mammalian Endogenous Transcription and Epigenetic States", Nature, vol. 500, No. 7463, Aug. 22, 2013, 472-476.
Lee, et al., "Synthetically Modified Guide RNA and Donor DNA are a Versatile Platform for CRISPR-Cas9 Engineering", eLIFE, vol. 6, 2017, 23 pages.
Makarova, et al., "Annotation and Classification of CRISPR-Cas Systems", Methods in Molecular Biology, vol. 1311, 2015, 47-75.
Mali, et al., "RNA-Guided Human Genome Engineering via Cas9", Science, vol. 339, No. 6121, Feb. 15, 2013, 823-826.
Marraffini, "CRISPR-Cas Immunity in Prokaryotes", Nature, vol. 526, Oct. 1, 2015, 55-62.

(56) References Cited

OTHER PUBLICATIONS

Mohanraju, "Diverse Evolutionary Roots and Mechanistic Variations of the CRISPR-Cas Systems", Science, vol. 353, Issue 6299, Aug. 5, 2016, 14 pages.
Mojica, et al., "Short Motif Sequences Determine the Targets of the Prokaryotic CRISPR Defence System", Microbiology, vol. 155( pt 3), Mar. 2009, 733-740.
Nishida, et al., "Targeted Nucleotide Editing Using Hybrid Prokaryotic and Vertebrate Adaptive Immune Systems", Science, vol. 353, No. 6305, 2016, 10 pages.
Nishimasu, et al., "Crystal Structure of Cas9 in Complex with Guide RNA and Target DNA", Cell, vol. 156, No. 5, Feb. 27, 2014, 935-949.
Nishimasu, et al., "Crystal Structure of *Staphylococcus aureus* Cas9", Cell, vol. 162, No. 5, Aug. 27, 2015, 1113-1126.
Parks, et al., "Tn7 Elements: Engendering Diversity from Chromosomes to Episomes", Plasmid, vol. 61, No. 1, Jan. 2009, 1-14.
Parnas, et al., "A Genome-Wide CRISPR Screen in Primary Immune Cells to Dissect Regulatory Networks", Cell, vol. 162, No. 3, Jul. 30, 2015, 675-686.
Peters, et al., "Recruitment of CRISPR-Cas Systems by Tn7-Like Transposons", Proceedings of the National Academy of Sciences, vol. 114, No. 35, 2017, E7358-E7366.
Peters, "Tn7", Microbiology Spectrum, vol. 2 No. 5, Oct. 2014, 20 pages.
Peters, et al., "Tn7 Recognizes Transposition Target Structures Associated with DNA Replication using the DNA-Binding Protein TnsE", Genes & Development, vol. 15, No. 6, Mar. 15, 2001, 737-747.
Peters, et al., "Tn7: Smarter than we thought", Nature Reviews Molecular Cell Biology, vol. 2, No. 11, Dec. 2001, 806-814.
Platt, et al., "CRISPR-Cas9 Knockin Mice for Genome Editing and Cancer Modeling", Cell, vol. 159, No. 2, Oct. 9, 2014, 440-455.
Qi, et al., "Repurposing CRISPR as an RNA-Guided Platform for Sequence-Specific Control of Gene Expression", Cell, vol. 152, No. 5, Feb. 28, 2013, 1173-1183.
Ramanan, et al., "CRISPR/Cas9 Cleavage of Viral DNA Efficiently Suppresses Hepatitis B Virus", Scientific Reports, vol. 5, No. 10833, Jun. 2, 2015, 9 pages.
Ran, et al., "Double Nicking by RNA-Guided CRISPR Cas9 for Enhanced Genome Editing Specificity", Cell, vol. 154, No. 6, Sep. 12, 2013, 1380-1389.
Ran, et al., "Genome Engineering Using the CRISPR-Cas9 System", Nature Protocols, vol. 8, No. 11, Nov. 2013, 2281-2308.
Ran, et al., "In Vivo Genome Editing Using *Staphylococcus aureus* Cas9", Nature, vol. 520, No. 7546, Apr. 9, 2015, 186-191.
Sarnovsky, et al., "The Tn7 Transposase is a Heteromeric Complex in which DNA Breakage and Joining Activities are Distributed between Different Gene Products", The EMBO Journal, vol. 15, No. 22, 1996, 6348-6361.
Schmid-Burgk, et al., "CRISpaint Allows Modular Base-Specific Gene Tagging Using a Ligase-4-Dependent Mechanism", Nature Communications, vol. 7, No. 12338, Jul. 2016.
Shalem, et al., "Genome-Scale CRISPR-Cas9 Knockout Screening in Human Cells", Science, vol. 343, No. 6166, Jan. 3, 2014, 84 87.
Shalem, et al., "High-Throughput Functional Genomics Using CRISPR-Cas9", Nature Reviews Genetics, vol. 16, No. 5, May 2015, 299-311.
Shmakov, et al., "Discovery and Functional Characterization of Diverse Class 2 CRISPR-Cas Systems", Molecular Cell, vol. 60, No. 3, Nov. 5, 2015, 385-397.
Shmakov, et al., "Diversity and Evolution of Class 2 CRISPR-Cas Systems", Nature Reviews Microbiology, vol. 15, No. 3, Mar. 2017, 169-182.
Slaymaker, et al., "Rationally Engineered Cas9 Nucleases with Improved Specificity", Science, vol. 351, No. 6268, Jan. 1, 2016, 84-88.
Strecker, et al., "Engineering of CRISPR-Cas12b for Human Genome Editing", Nature Communications, vol. 10, No. 1, 2019, 8 pages.
Suzuki, et al., "In Vivo Genome Editing Via CRISPR/Cas9 Mediated Homology-Independent Targeted Integration", Nature, vol. 540, 2016, 144-149.
Swiech, et al., "In Vivo Interrogation of Gene Function in the Mammalian Brain Using CRISPR-Cas9", Nature Biotechnology, vol. 33, No. 1, Jan. 2015, 102-106.
Teng, et al., "Repurposing CRISPR-Cas12b for Mammalian Genome Engineering", Cell Discovery, vol. 4, No. 63, 2018, 15 pages.
Waddell, et al., "Tn7 Transposition: Recognition of the Atttn7 Target Sequence", Proceedings of the National Academy of Sciences, vol. 86, No. 11, Jun. 1989, 3958-3962.
Waddell, et al., "Tn7 Transposition: Two Transposition Pathways Directed by Five Tn7-Encoded Genes", Genes & Development, vol. 2, No. 2, Feb. 1988, 137-149.
Wang, et al., "Genetic Screens in Human Cells Using the CRISPR/Cas9 System", Science, vol. 343, No. 6166, Jan. 3, 2014, 80-84.
Wang, et al., "One-Step Generation of Mice Carrying Mutations in Multiple Genes by CRISPR/Cas-Mediated Genome Engineering", Cell, vol. 153, No. 4, May 9, 2013, 910-918.
Wu, et al., "Genome-Wide Binding of the CRISPR Endonuclease Cas9 in Mammalian Cells", Nature Biotechnology, vol. 32, No. 7, Jul. 2014, 670-676.
Xu, et al., "Sequence Determinants of Improved CRISPR SgRNA Design", Genome Research, vol. 25, No. 8, Aug. 2015, 1147-1157.
Zetsche, et al., "A Split-Cas9 Architecture for Inducible Genome Editing and Transcription Modulation", Nature Biotechnology, vol. 33, No. 2, Feb. 2015, 139-142.
Zetsche, et al., "Cpf1 is a Single RNA-Guided Endonuclease of a Class 2 CRISPR-Cas System", Cell, vol. 163, No. 3, Oct. 22, 2015, 759-771.
Zhang, et al., "Efficient construction of sequence-specific TAL effectors for modulating mammalian transcription", Nature Biotechnology, vol. 29, No. 2, 2011, 149-153.
Chen, et al., "An Engineered Cas-Transposon System for Programmable and Precis DNA Transpositions," doi: http://dx.doi.org/10.1101/654996, Jun. 3, 2019, all enclosed pages cited.

* cited by examiner

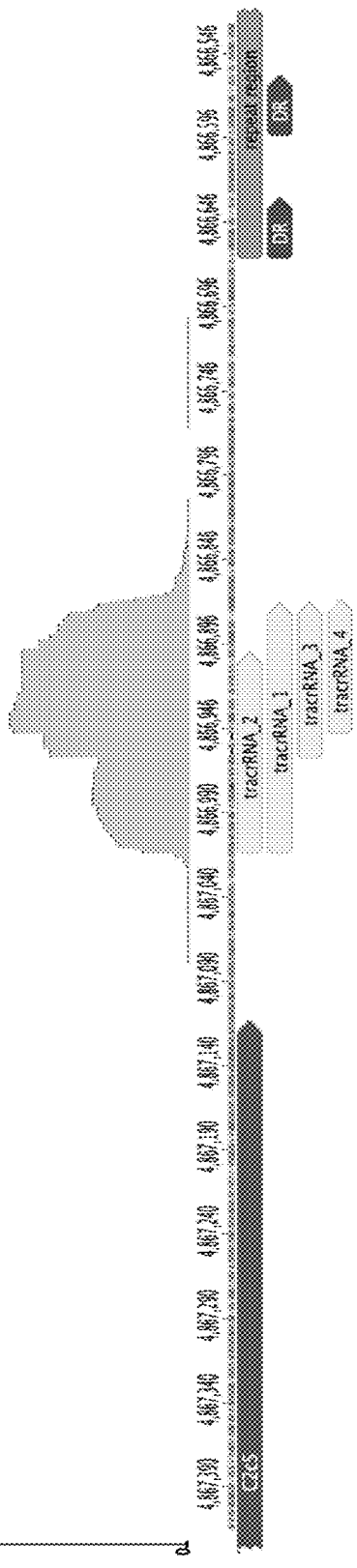
FIG. 4A
FIG. 4B
SEQ ID NO:1-4
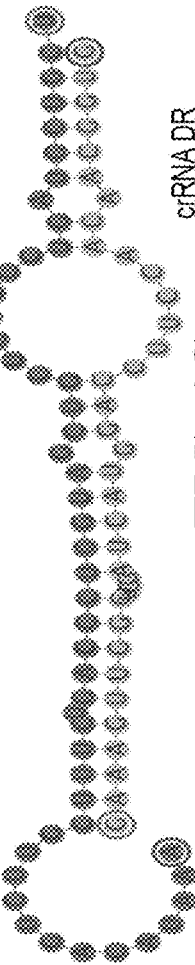
FIG. 4C

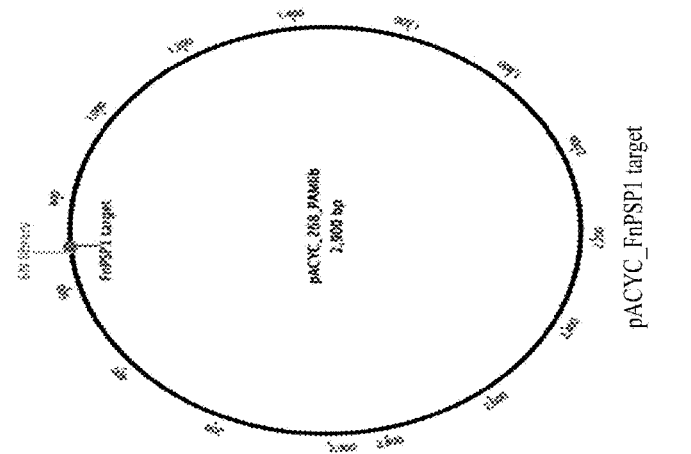

FIG. 6A

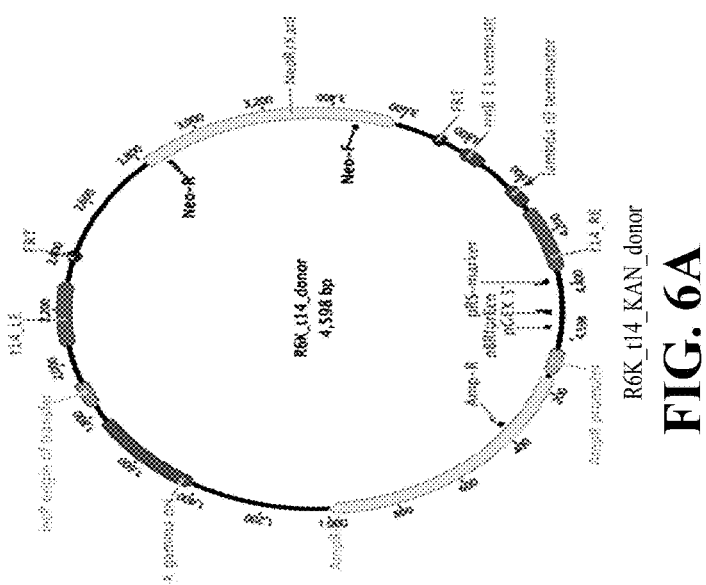

FIG. 6A

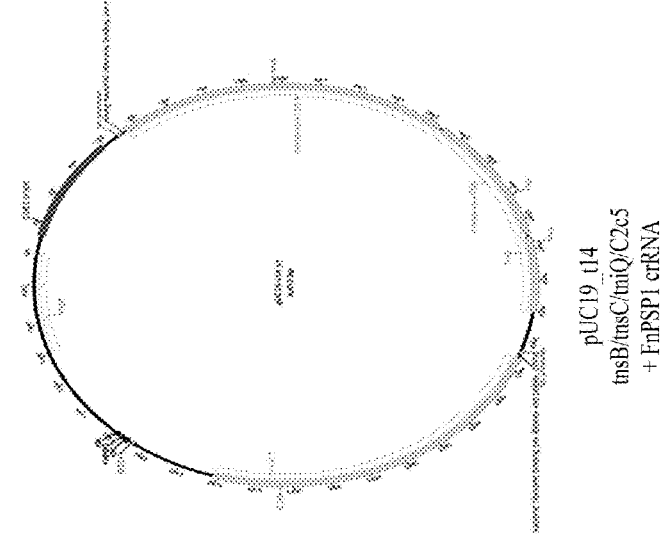

FIG. 6B

SEQ ID NO: 5-6 agaagatcatcttattaataTACGTAGTATCTACGATACGTAGTATCTACGGTAGATATATCTTACGATACGTAGATATCTTAAAGTAGATACTAGMMMMKGAGAATCGTTAGMMMNNNNKGAGAATGAAGCCACTGTTAAAGCTAGATATCTACGGTAGATATATCTACGGATACGTAGGCCGATGCGGCTGGCTAC
tcttctagtagtaataattaTATGCATCGATAGATAGTCTATAGATGCATCATAGATCATAGAATGTCTATAGATGCATCATAGATCATATAGATGCATCGCCGGCTGCGGACCGATG

FIG. 6B

FIG. 8A  SEQ ID NO:7-8

FIG. 8B  SEQ ID NO:9-10

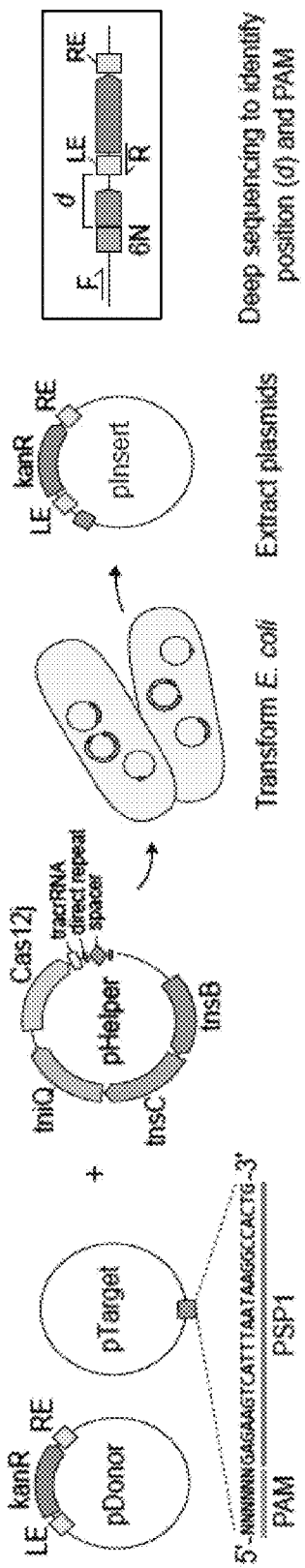
FIG. 14A
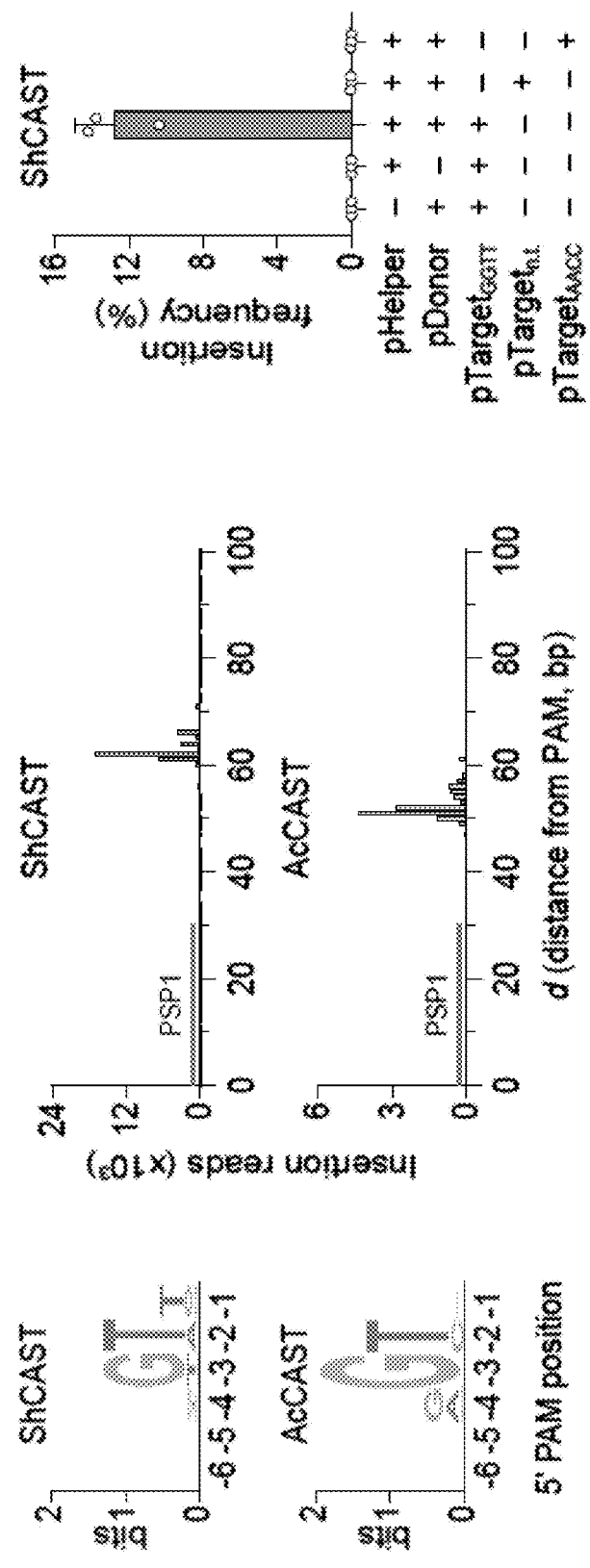
FIG. 14B
FIG. 14C
FIG. 14D

SEQ ID NO:16-19

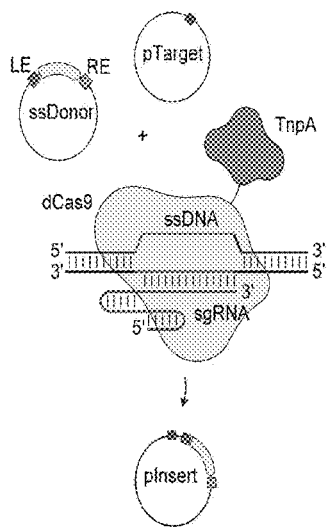

FIG. 19A

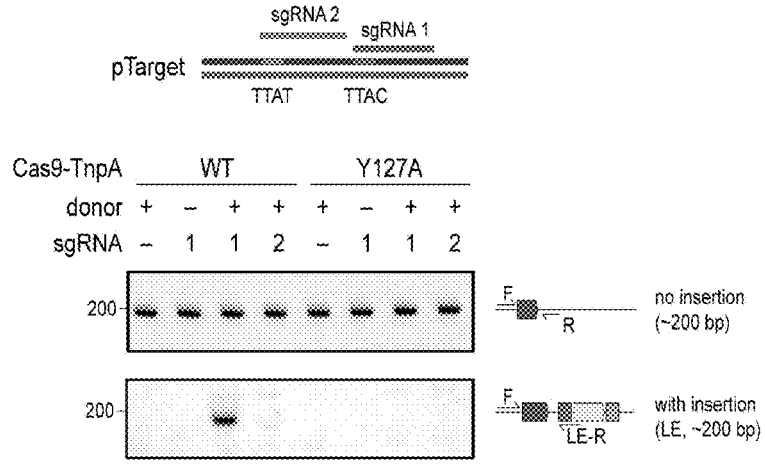

FIG. 19B

| | Insertion site | LE | | RE | |
|---|---|---|---|---|---|
| Target | GATCCTGCTTGCATGTAGTCAGTTATCAGGTCAGTCGTTAC | | | CGGTCATGATCACGCTATAGCGA | |
| 1 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 2 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 3 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 4 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 5 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 6 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 7 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 8 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 9 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |
| 10 | GATCCTGCTTGCATGTAGTCAGTTATCAGGTCAGTCGTTAC | CAAAACTAACGCCTTAAAGCCCCTAGCTT- | | CCCTAGCTTTAGCTATGGGGAGTATGTCAAACGGCGATGCTAGAAGACGGTCATGATCACGCTATAGCGA | |

FIG. 19C SEQ ID NO:20-30

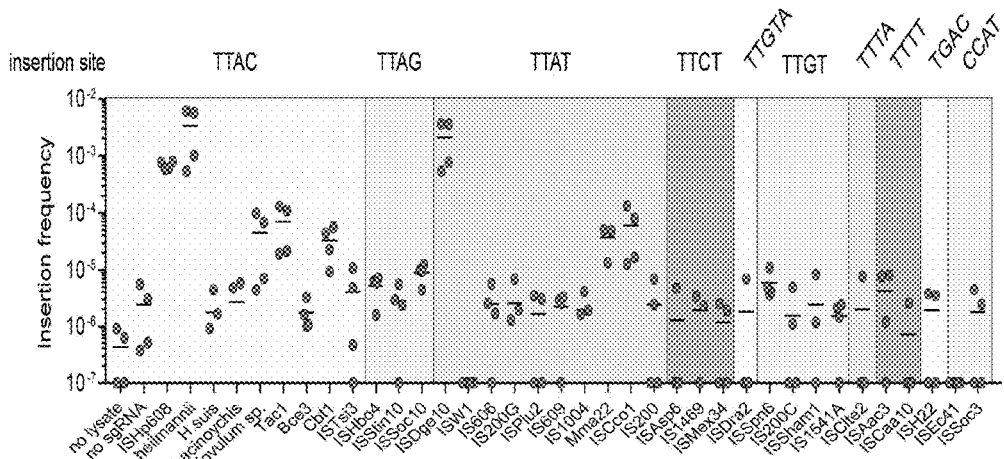

FIG. 19D

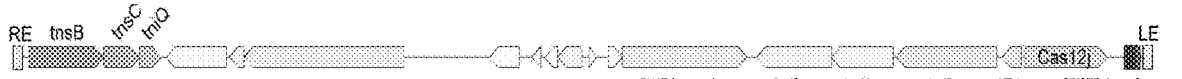
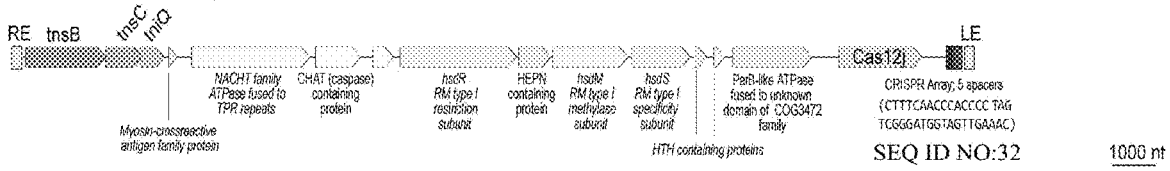
FIG. 20A
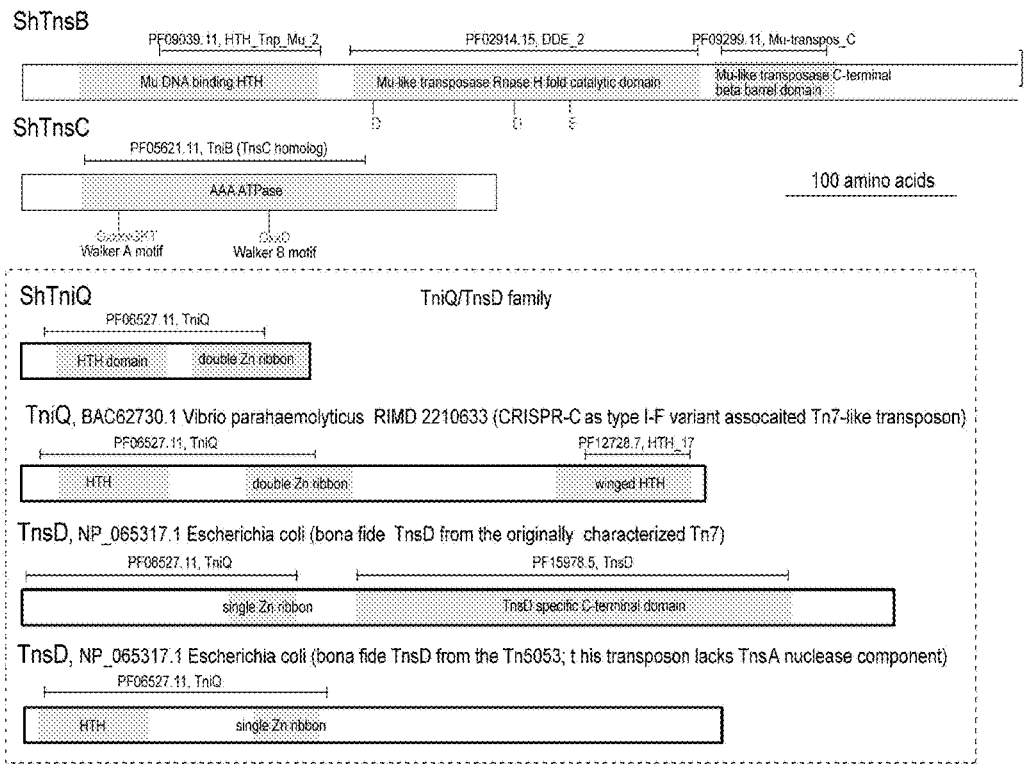
FIG. 20B
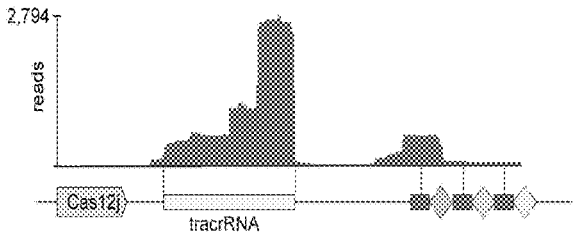
FIG. 20C

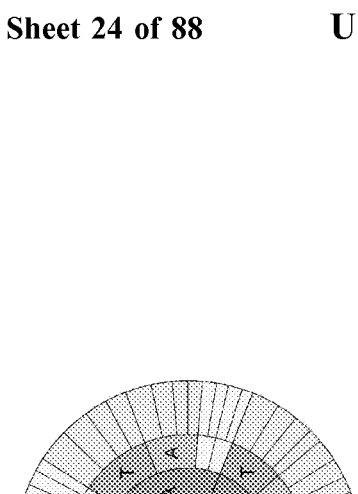
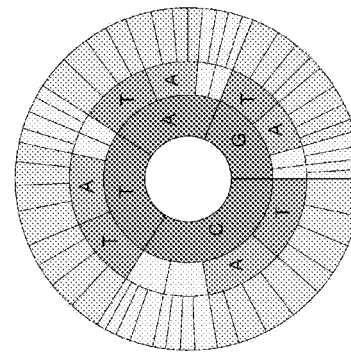
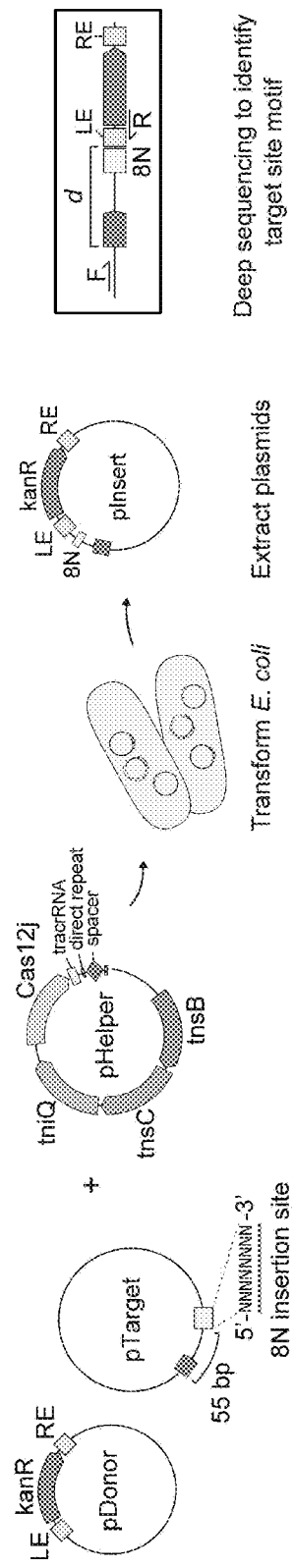
FIG. 23A
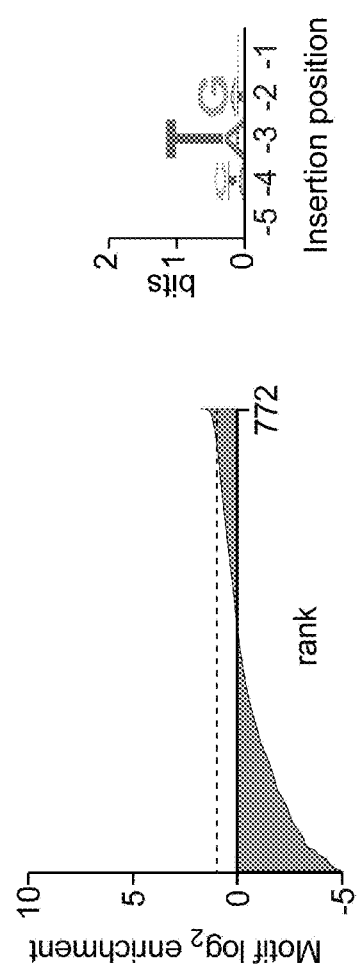
FIG. 23B
FIG. 23C
FIG. 23D

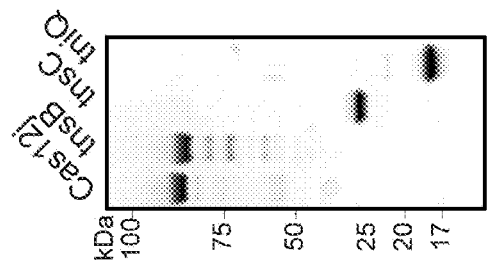
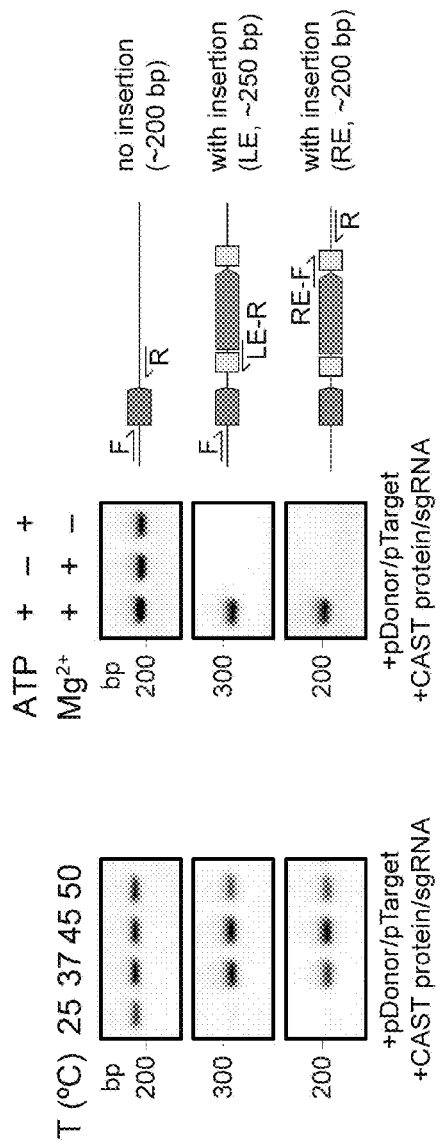
FIG. 25B
FIG. 25C
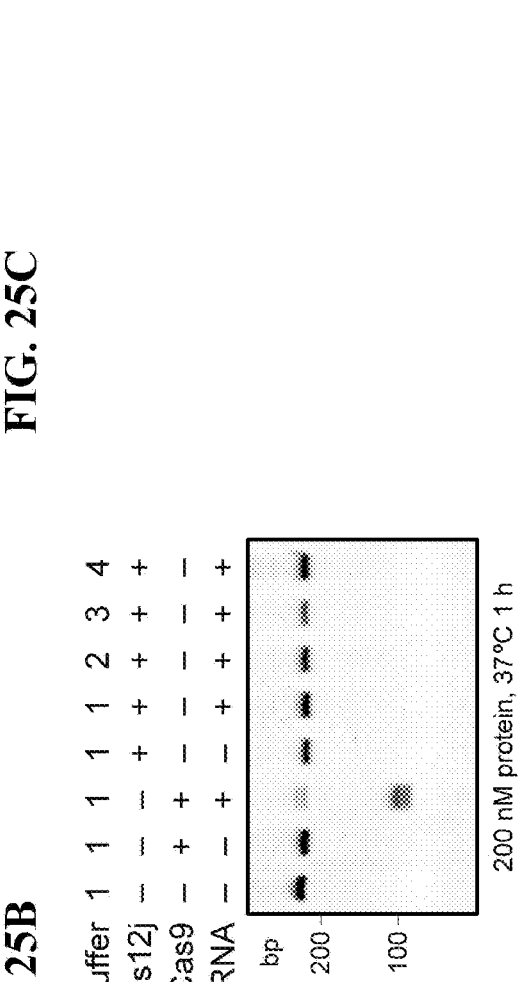
FIG. 25A
FIG. 25D

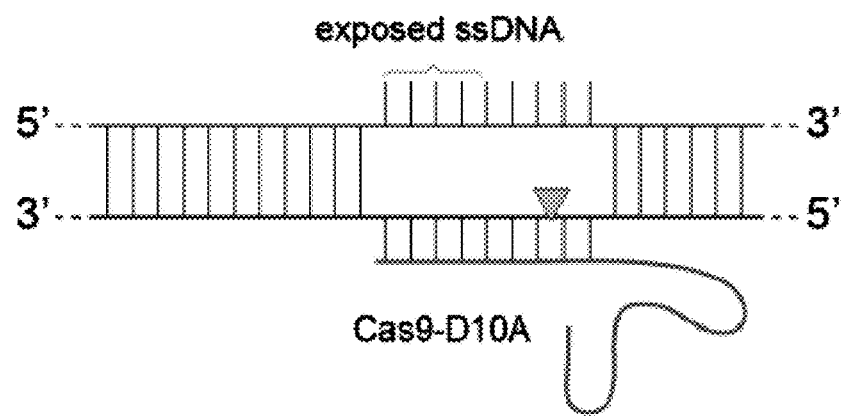
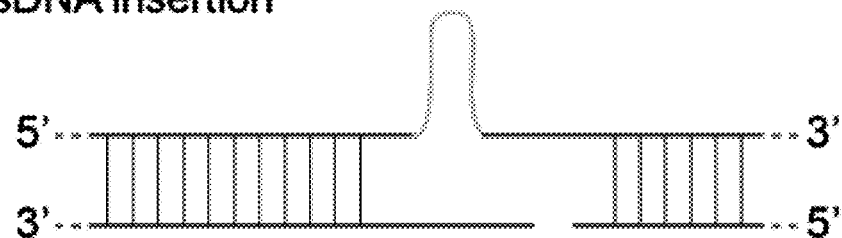
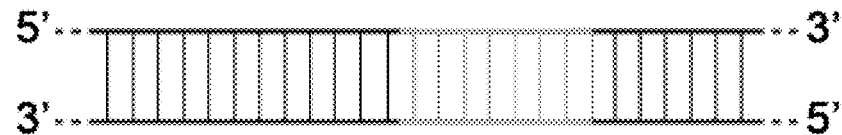
FIG. 32

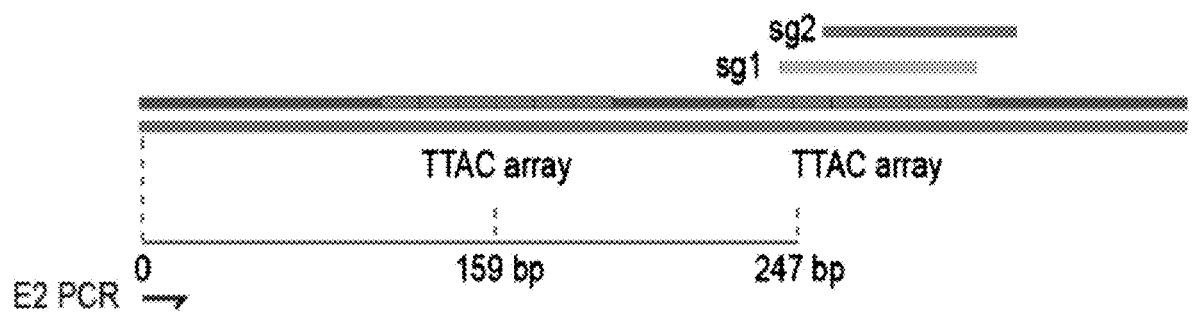
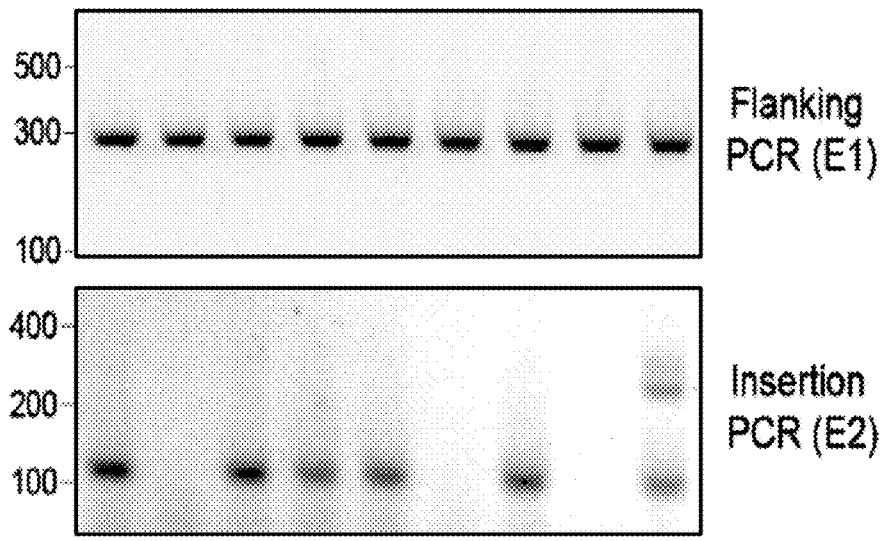
FIG. 38

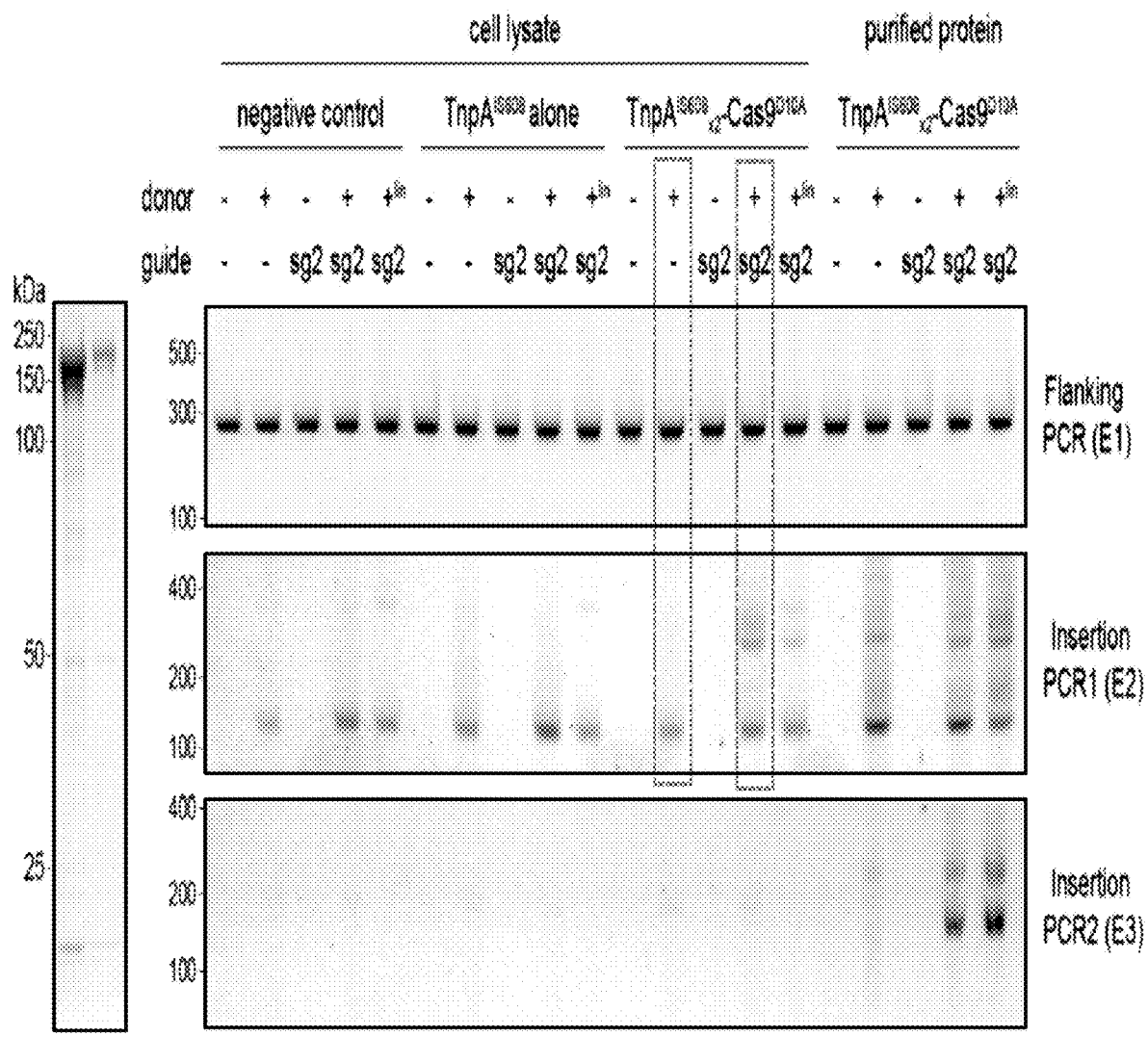
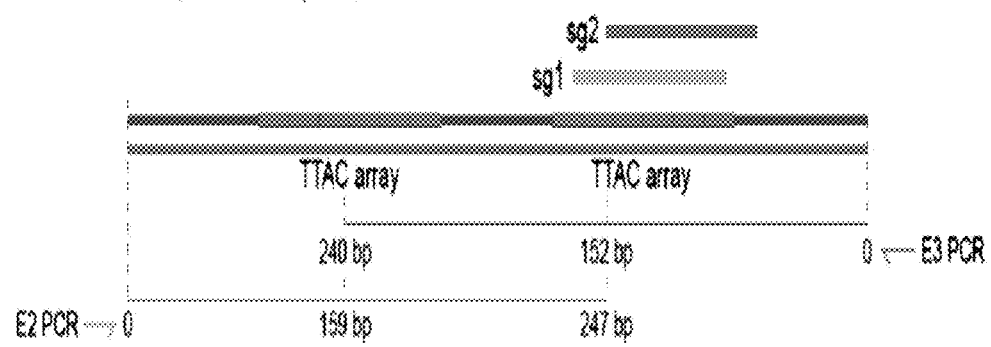
FIG. 39

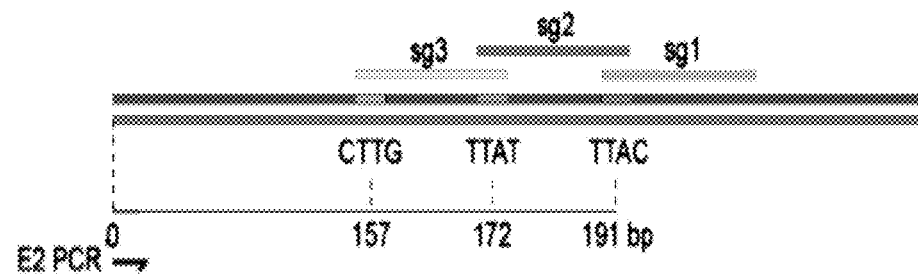
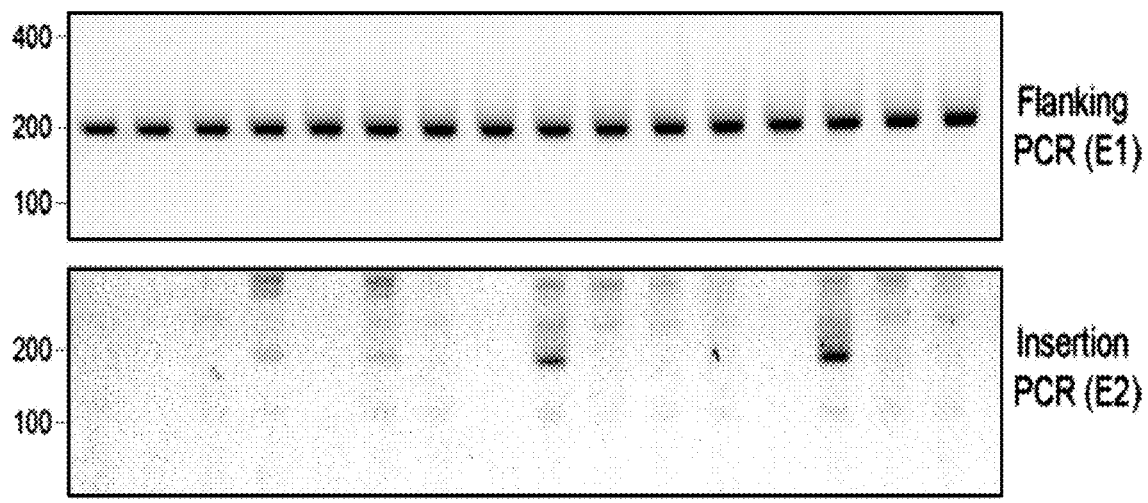
FIG. 41

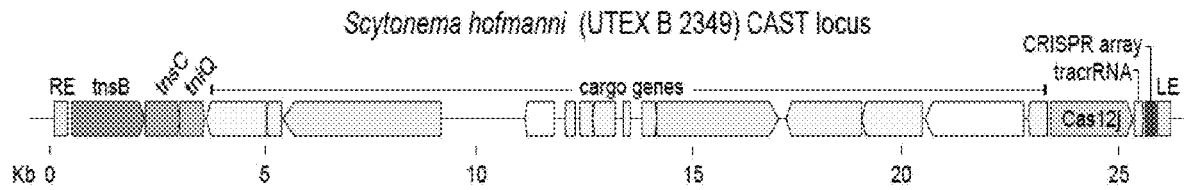
FIG. 42A
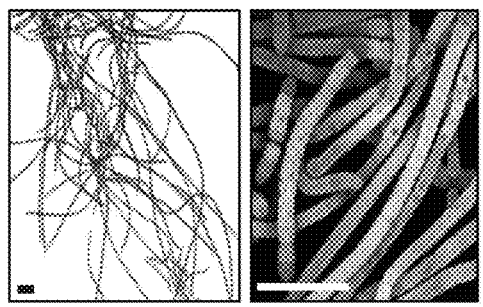
FIG. 42B
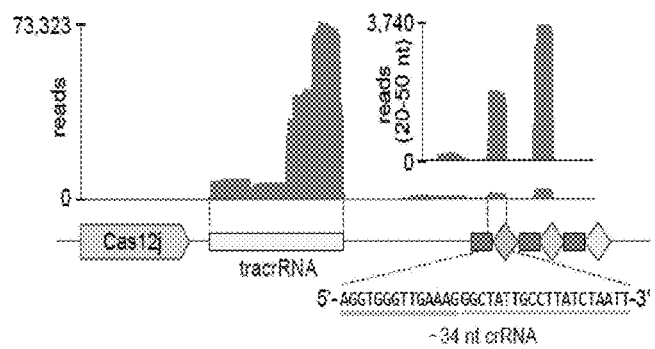
FIG. 42C    SEQ ID NO:56
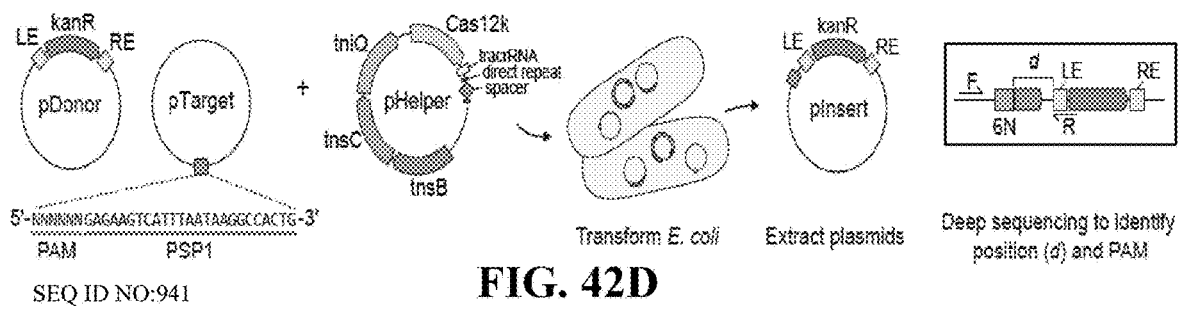
SEQ ID NO:941    FIG. 42D
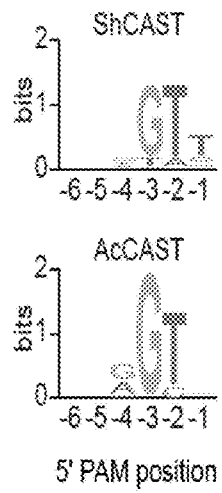
FIG. 42E
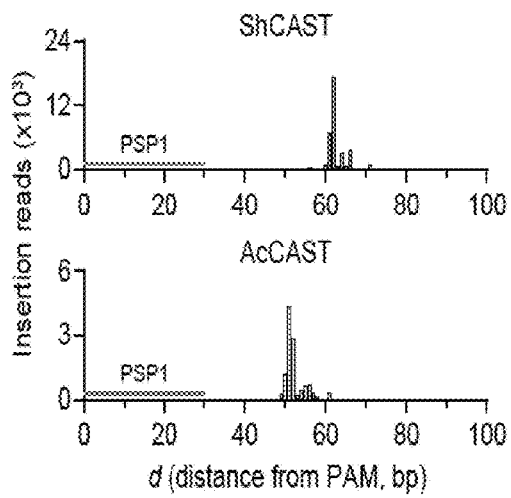
FIG. 42F
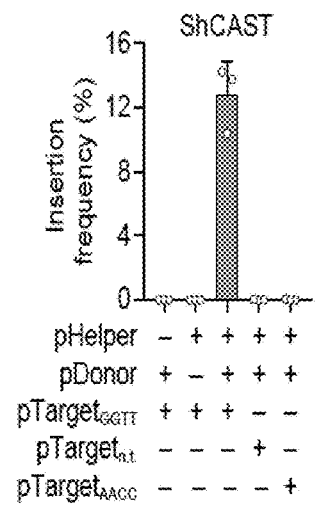
FIG. 42G

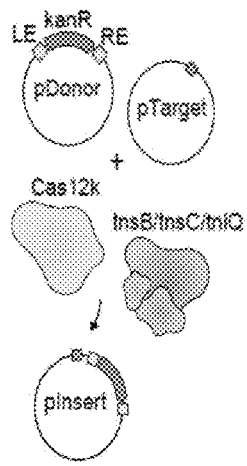
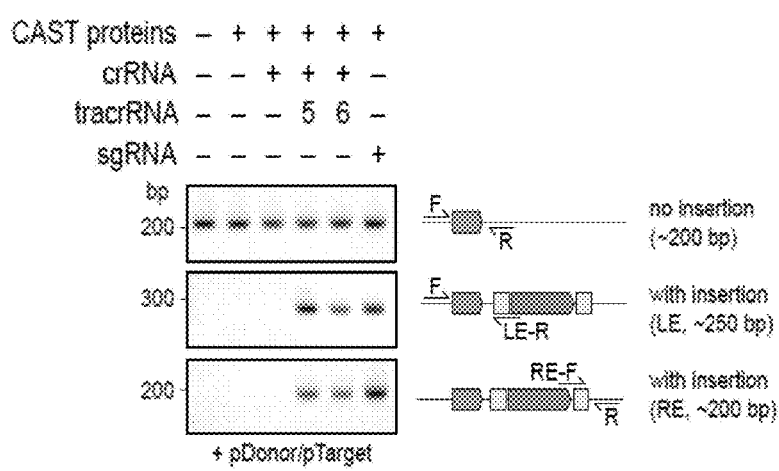
FIG. 44A  FIG. 44B
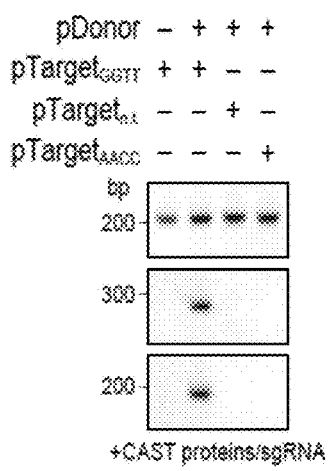 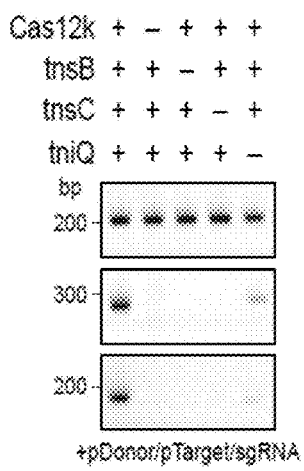 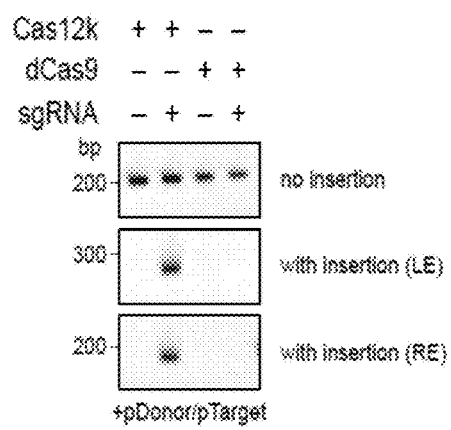
FIG. 44C  FIG. 44D  FIG. 44E
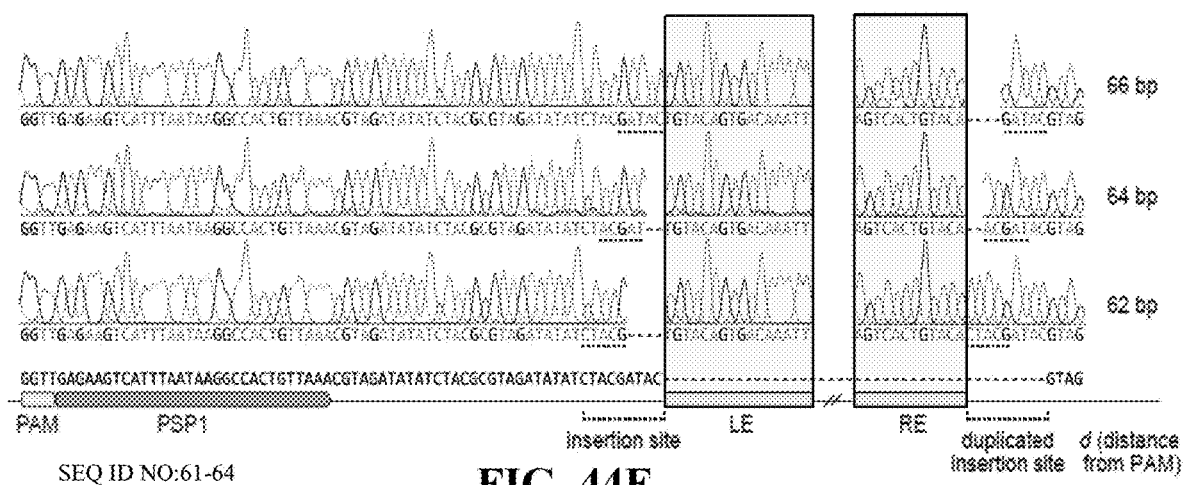
SEQ ID NO:61-64
FIG. 44F

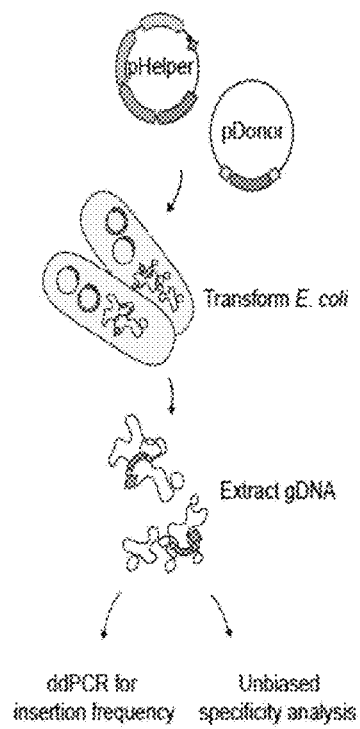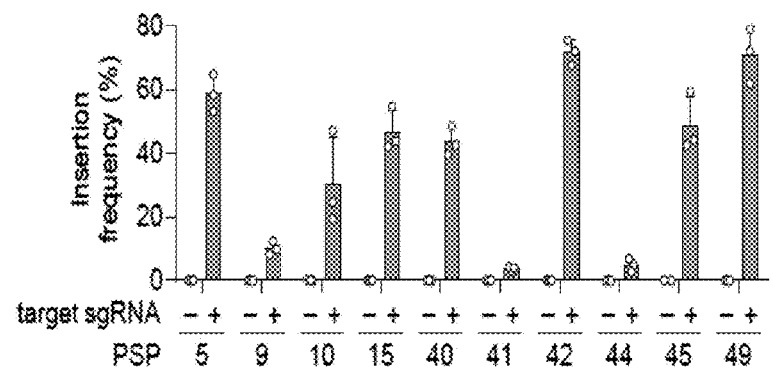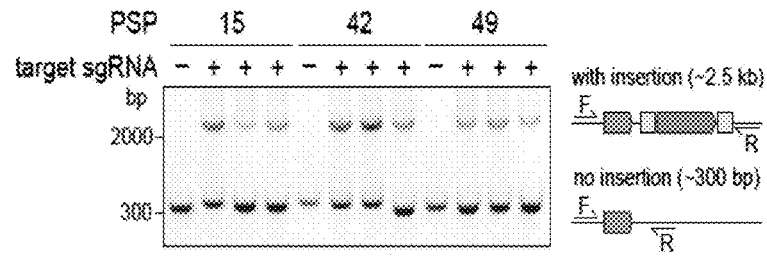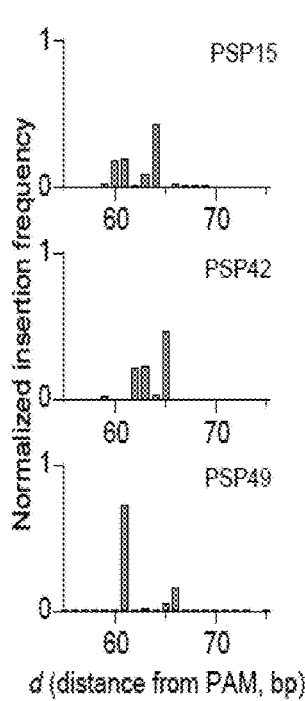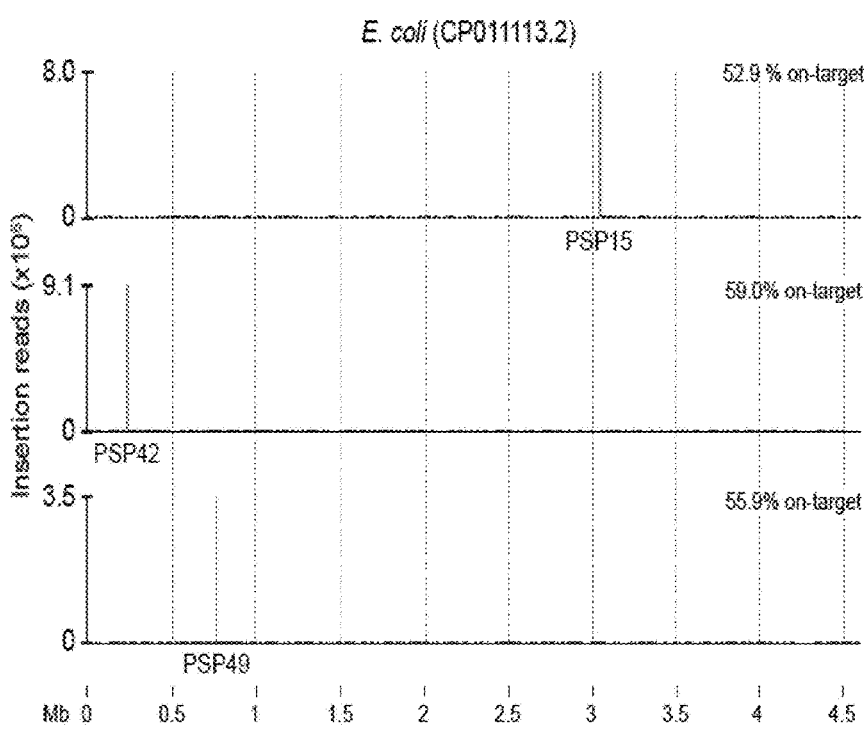
FIG. 45A
FIG. 45B
FIG. 45C
FIG. 45D
FIG. 45E

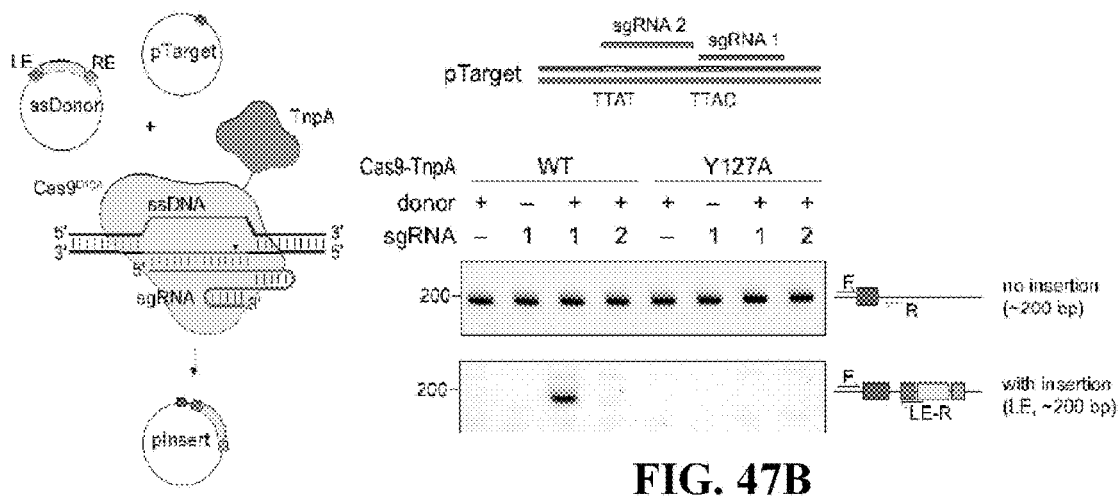
FIG. 47A
FIG. 47B
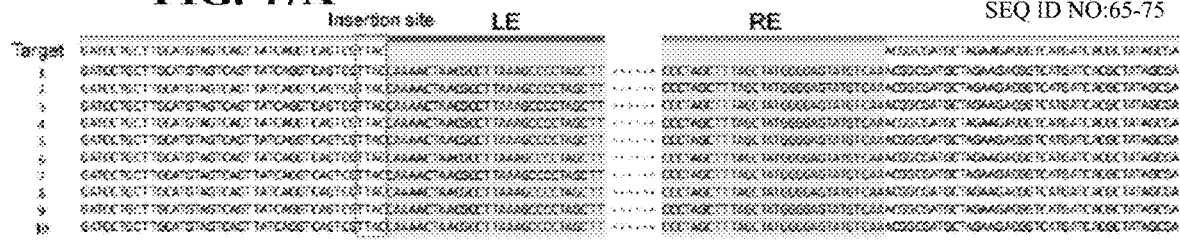
FIG. 47C
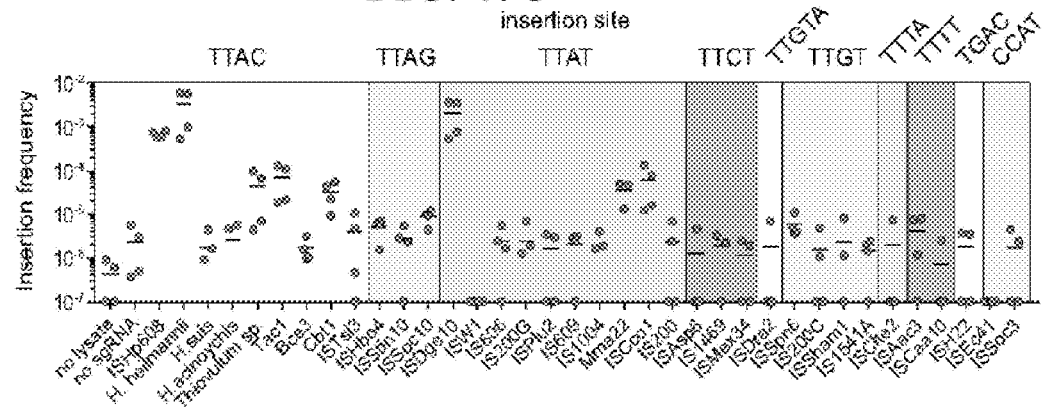
FIG. 47D
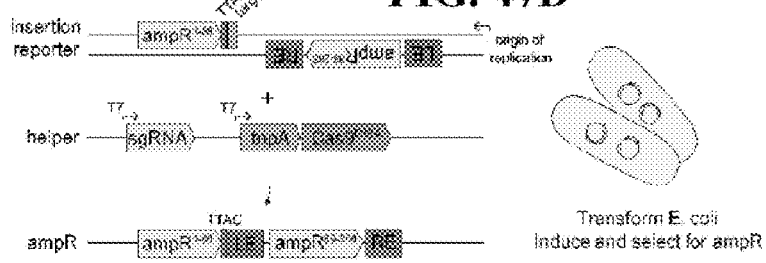
FIG. 47E
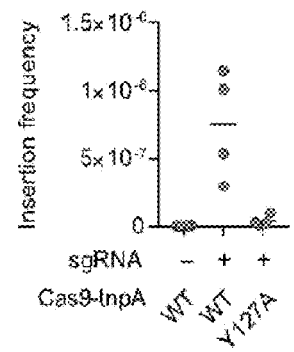
FIG. 47F

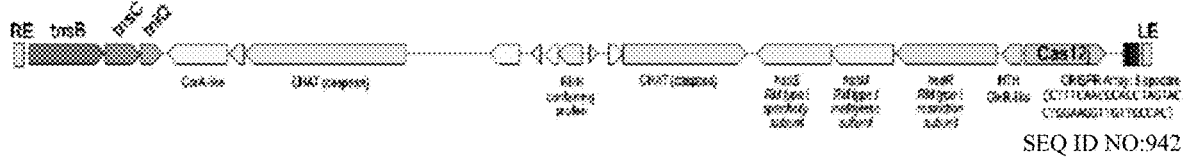
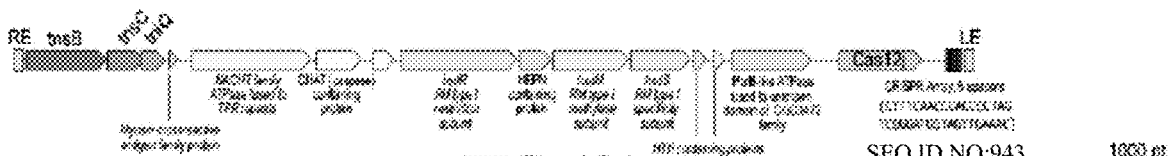
FIG. 48A
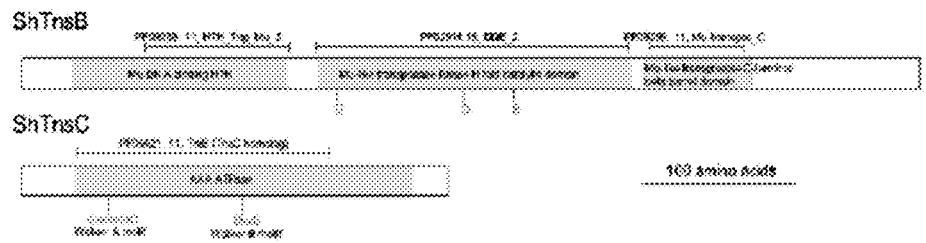
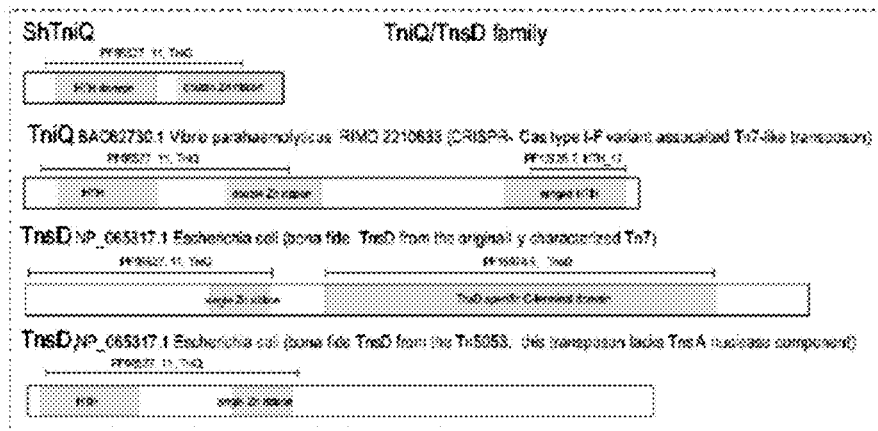
FIG. 48B
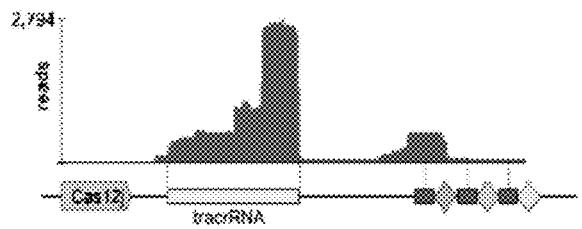
FIG. 48C

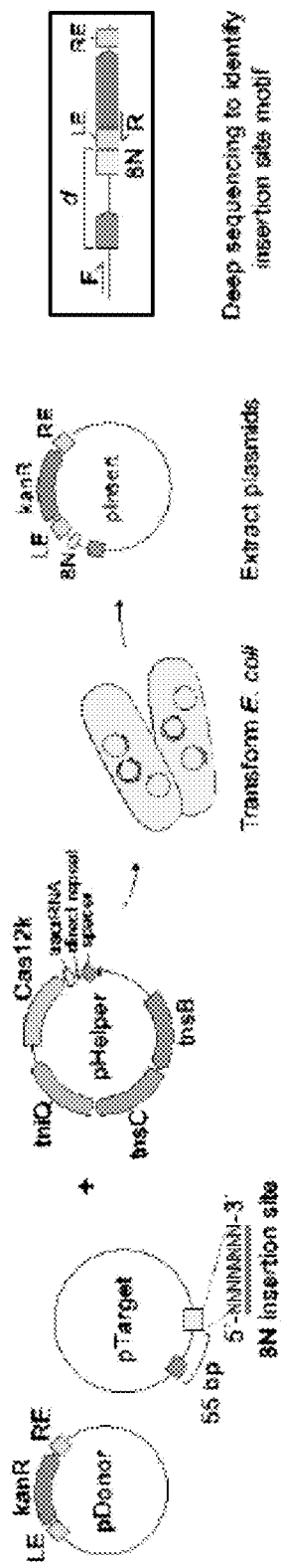
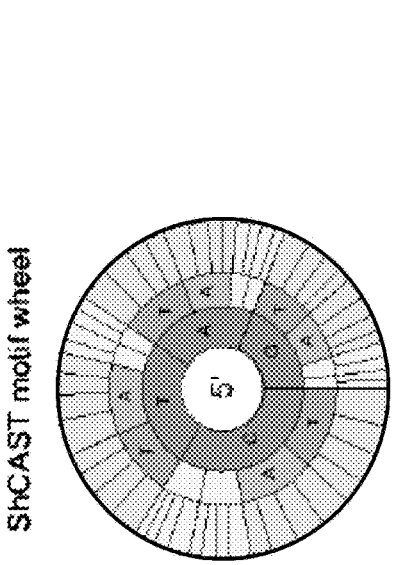
FIG. 51A
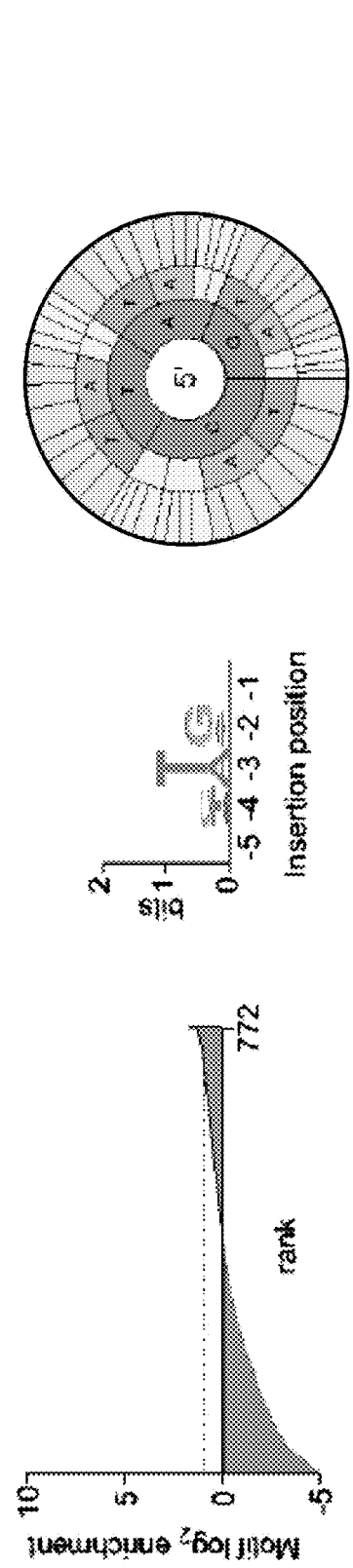
FIG. 51BC
FIG. 51C
FIG. 51D

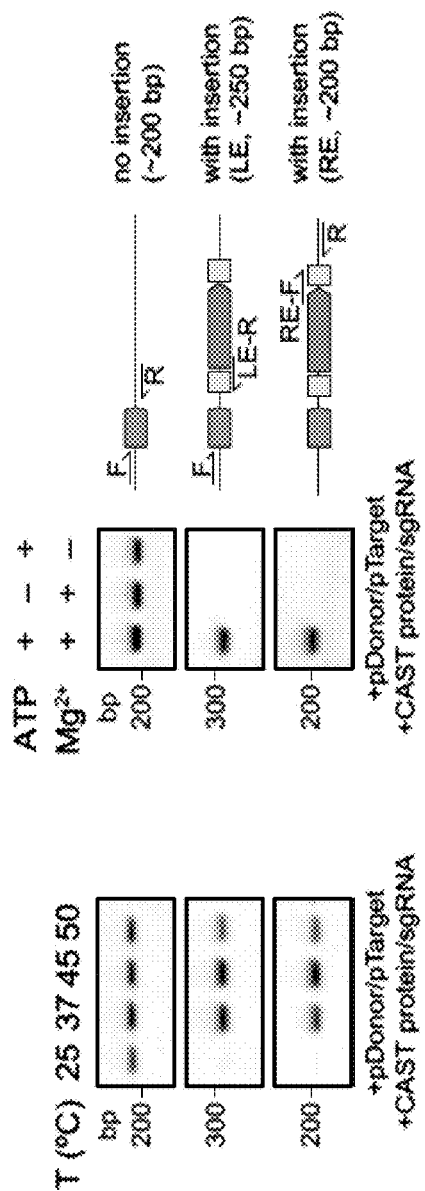
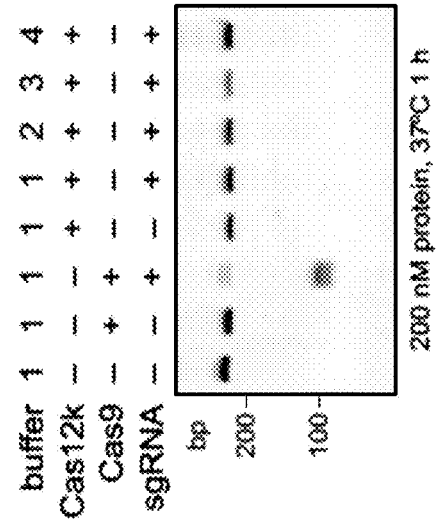
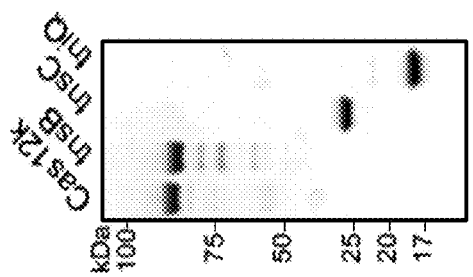
FIG. 54A   FIG. 54B   FIG. 54C   FIG. 54D

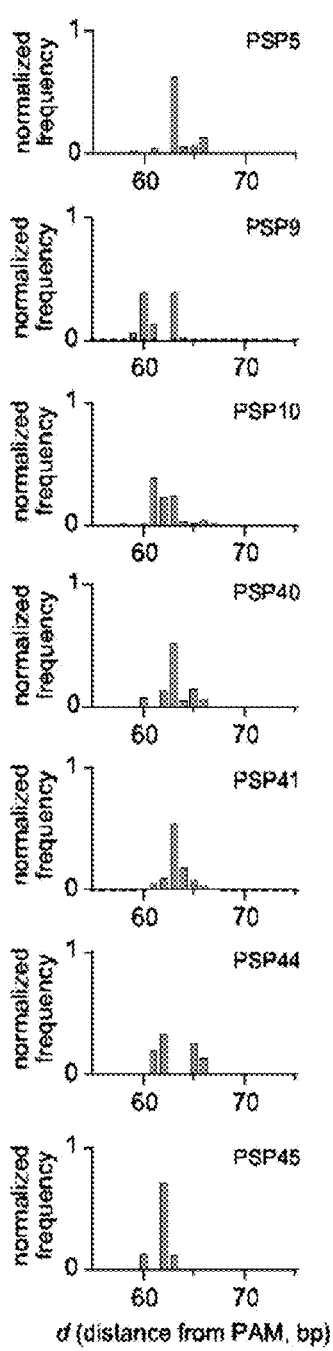
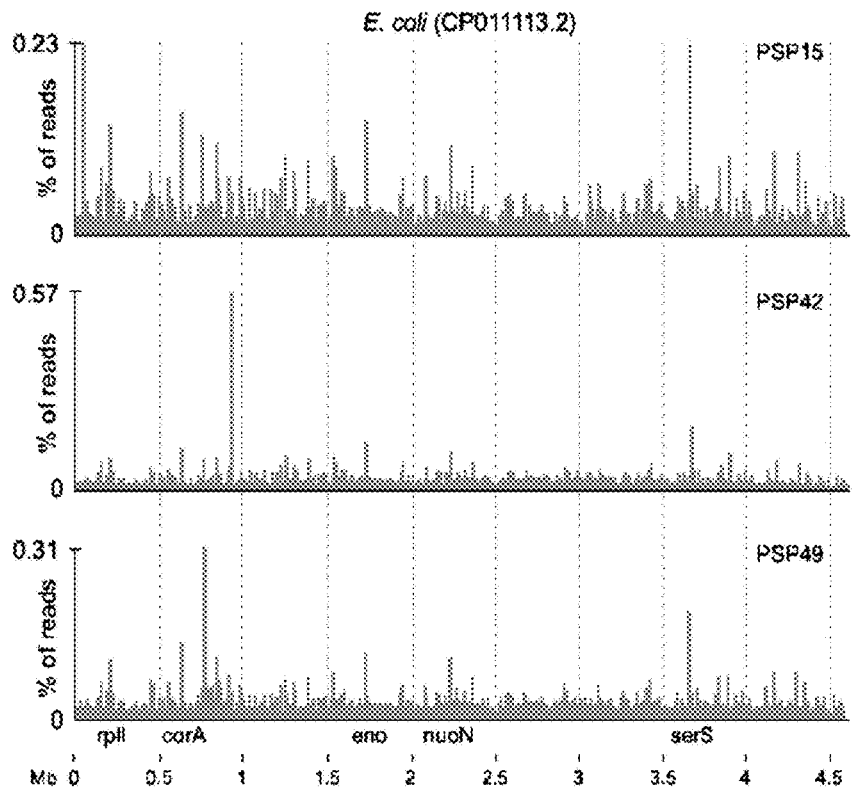
FIG. 56B
```
              PAM                              Reads
PSP42   NGTNACTATAGACTATCCGGGCAATGT    9114248
Off-target  . . . . . . . . . . . GA. . . . . . . TT. . . .   87258 (0.9%)
```
FIG. 56C  SEQ ID NO:93-94
FIG. 56A

SEQ ID NO:121-144

SEQ ID NO:203-260

FIG. 76C

SEQ ID NO:261-308

FIG. 76D

SEQ ID NO:309-367 pcdna3-t59-k-cas9-fusion-c-term-ruvc (1)
10,858 bp

SEQ ID NO:382-385 pcdna3-t59-k-cas9-fusion-n-term-ruvc (1)
10,855 bp

SEQ ID NO:386-389

CRISPR-ASSOCIATED TRANSPOSASE SYSTEMS AND METHODS OF USE THEREOF

CROSS-REFERENCE TO RELATED APPLICATIONS

This application claims the benefit of U.S. Provisional Application No. 62/780,658 filed Dec. 17, 2018, U.S. Provisional Application No. 62/783,878, filed Dec. 21, 2018, U.S. Provisional Application No. 62/820,639, filed Mar. 19, 2019, U.S. Provisional Application No. 62/830,059, filed Apr. 5, 2019, U.S. Provisional Application No. 62/837,695, filed Apr. 23, 2019, U.S. Provisional Application No. 62/844,685, filed May 7, 2019, U.S. Provisional Application No. 62/852,922, filed May 24, 2019, U.S. Provisional Application No. 62/855,763, filed May 31, 2019, U.S. Provisional Application No. 62/862,531, filed Jun. 17, 2019, U.S. Provisional Application No. 62/871,683, filed Jul. 8, 2019, U.S. Provisional Application No. 62/904,548, filed Sep. 23, 2019, U.S. Provisional Application No. 62/914,471, filed Oct. 12, 2019. The entire contents of the above-identified applications are hereby fully incorporated herein by reference.

STATEMENT REGARDING FEDERALLY SPONSORED RESEARCH

This invention was made with government support under Grant Nos. MH110049 and HL141201 awarded by the National Institutes of Health. The government has certain rights in the invention.

REFERENCE TO AN ELECTRONIC SEQUENCE LISTING

The contents of the electronic sequence listing ("BROD_4220WP_ST25.txt"; Size is 1,184,543 bytes and it was created on Dec. 17, 2019) is herein incorporated by reference in its entirety.

TECHNICAL FIELD

The present invention generally relates to systems, methods and compositions used for targeted gene modification, targeted insertion, perturbation of gene transcripts, and nucleic acid editing. Novel nucleic acid targeting systems comprise components of Clustered Regularly Interspaced Short Palindromic Repeats (CRISPR) systems and transposable elements.

BACKGROUND

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that employ novel strategies and molecular mechanisms and are affordable, easy to set up, scalable, and amenable to targeting multiple positions within the eukaryotic genome. This would provide a major resource for new applications in genome engineering and biotechnology.

The CRISPR-Cas systems of bacterial and archaeal adaptive immunity show extreme diversity of protein composition, genomic loci architecture, and system function, and systems comprising CRISPR-like components are widespread and continue to be discovered. Novel Class 1 multisubunit effector complexes and Class 2 single-subunit effector modules may be developed as powerful genome engineering tools. These are exemplified by bacterial and archaeal genomes comprising Tn7-like transposons associated with Class 1 and Class 2 CRISPR-Cas systems and CRISPR arrays.

Citation or identification of any document in this application is not an admission that such document is available as prior art to the present invention.

SUMMARY

In one aspect, the present disclosure provides an engineered nucleic acid targeting system for insertion of donor polynucleotides, the system comprising: a) one or more CRISPR-associated transposase proteins or functional fragments thereof; b) a Cas protein; and c) a guide molecule capable of complexing with the Cas protein and directing sequence specific binding of the guide-Cas protein complex to a target sequence of a target polynucleotide.

In some embodiments, the one or more CRISPR-associated transposase proteins comprises i) TnsB and TnsC, or ii) TniA and TniB. In some embodiments, the one or more CRISPR-associated transposase proteins comprises: a) TnsA, TnsB, TnsC, and TniQ, b) TnsA, TnsB, and TnsC, c) TnsB, TnsC, and TniQ, d) TnsA, TnsB, and TniQ, e) TnsE, f) TniA, TniB, and TniQ, g) TnsB, TnsC, and TnsD, or h) any combination thereof. In some embodiments, the one or more CRISPR-associated transposase proteins comprises TnsB, TnsC, and TniQ. In some embodiments, the TnsB, TnsC, and TniQ are encoded by polynucleotides in Table 27 or Table 28, or are proteins in Table 29 or Table 30. In some embodiments, the TnsE does not bind to DNA. In some embodiments, the one or more CRISPR-associated transposase proteins is one or more Tn5 transposases. In some embodiments, the one or more CRISPR-associated transposase proteins is one or more Tn7 transposases or Tn7-like transposases. In some embodiments, the one or more CRISPR-associated transposase proteins comprises TnpA. In some embodiments, the one or more CRISPR-associated transposase proteins comprises $TnpAI_{S608}$. In some embodiments, the system further comprises a donor polynucleotide for insertion into the target polynucleotide. In some embodiments, the donor polynucleotide is to be inserted at a position between 40 and 100 bases downstream a PAM sequence in the target polynucleotide. In some embodiments, the donor polynucleotide is flanked by a right end sequence element and a left end sequence element.

In some embodiments, the donor polynucleotide: a) introduces one or more mutations to the target polynucleotide, b) introduces or corrects a premature stop codon in the target polynucleotide, c) disrupts a splicing site, d) restores or introduces a splice cite, e) inserts a gene or gene fragment at one or both alleles of a target polynucleotide, or f) a combination thereof. In some embodiments, the one or more mutations introduced by the donor polynucleotide comprises substitutions, deletions, insertions, or a combination thereof. In some embodiments, the one or more mutations causes a shift in an open reading frame on the target polynucleotide.

In some embodiments, the donor polynucleotide is between 100 bases and 30 kb in length.

In some embodiments, the Cas protein is a Type V Cas protein. In some embodiments, the Type V Cas protein is a Type V-J Cas protein. In some embodiments, the Cas protein is Cas12. In some embodiments, the Cas12 is Cas12a or Cas12b. In some embodiments, the Cas 12 is Cas12k. In some embodiments, the Cas12k is encoded by a polynucleotide in Table 27 or Table 28, or is a protein in Table 29 or Table 30. In some embodiments, the Cas12k is of an organism of FIGS. 2A and 2B, or Table 27. In some embodiments, the Cas protein comprises an activation mutation. In some embodiments, the Cas protein is a Type I Cas protein. In some embodiments, the Type I Cas protein comprises Cas5f, Cas6f, Cas7f, and Cas8f. In some embodiments, the Type I Cas protein comprises Cas8f-Cas5f, Cas6f and Cas7f. In some embodiments, the Type I Cas protein is a Type I-F Cas protein. In some embodiments, the Cas protein is a Type II Cas protein. In some embodiments, the Type II Cas protein is a mutated Cas protein compared to a wildtype counterpart. In some embodiments, the mutated Cas protein is a mutated Cas9. In some embodiments, the mutated Cas9 is Cas9$^{D10A}$.

In some embodiments, the Cas protein lacks nuclease activity. In some embodiments, the system further comprises a donor polynucleotide. In some embodiments, the CRISPR-Cas system comprises a DNA binding domain. In some embodiments, the DNA binding domain is a dead Cas protein. In some embodiments, the dead Cas protein is dCas9, dCas12a, or dCas12b. In some embodiments, the DNA binding domain is an RNA-guided DNA binding domain. In some embodiments, the target nucleic acid has a PAM. In some embodiments, the PAM is on the 5' side of the target and comprises TTTN or ATTN. In some embodiments, the PAM comprises NGTN, RGTR, VGTD, or VGTR. In some embodiments, the guide molecule is an RNA molecule encoded by a polynucleotide in Table 27.

In another aspect, the present disclosure provides an engineered system comprising one or more polynucleotides encoding components (a), (b) and/or (c) of herein. In some embodiments, one or more polynucleotides is operably linked to one or more regulatory sequence. In some embodiments, the system comprises one or more components of a transposon. In some embodiments, the one or more of protein and nucleic acid components are comprised by a vector. In some embodiments, the one or more transposases comprises TnsB, TnsC, and TniQ, and the Cas protein is Cas12k. In some embodiments, the one or more polynucleotides are selected from polynucleotides in Table 27.

In another aspect, the present disclosure provides a vector comprising one or more polynucleotides encoding components (a), (b) and/or (c) herein.

In another aspect, the present disclosure provides a cell or progeny thereof comprising the vector herein.

In another aspect, the present disclosure provides a cell comprising the system herein, or a progeny thereof comprising one or more insertions made by the system. In some embodiments, the cell is a prokaryotic cell. In some embodiments, the cell is a eukaryotic cell. In some embodiments, the cell is a mammalian cell, a cell of a non-human primate, or a human cell. In some embodiments, the cell is a plant cell. In another aspect, the present disclosure provides an organism or a population thereof comprising the cell herein.

In another aspect, the present disclosure provides a method of inserting a donor polynucleotide into a target polynucleotide in a cell, which comprises introducing into the cell: a) one or more CRISPR-associated transposases or functional fragments thereof, b) a Cas protein, c) a guide molecule capable of binding to a target sequence on a target polynucleotide, and designed to form a CRISPR-Cas complex with the Cas protein, and e) a donor polynucleotide, wherein the CRISPR-Cas complex directs the CRISPR-associated transposase to the target sequence and the CRISPR-associated transposase inserts the donor polynucleotide into the target polynucleotide at or near the target sequence.

In some embodiments, the donor polynucleotide is to be inserted at a position between 40 and 100 bases downstream a PAM sequence in the target polynucleotide. In some embodiments, the donor polynucleotide: a) introduces one or more mutations to the target polynucleotide, b) corrects or introduces a premature stop codon in the target polynucleotide, c) disrupts a splicing site, d) restores or introduces a splice cite, e) inserts a gene or gene fragment at one or both alleles of a target polynucleotide, or f) a combination thereof.

In some embodiments, the one or more mutations introduced by the donor polynucleotide comprises substitutions, deletions, insertions, or a combination thereof. In some embodiments, the one or more mutations causes a shift in an open reading frame on the target polynucleotide. In some embodiments, the donor polynucleotide is between 100 bases and 30 kb in length. In some embodiments, one or more of components (a), (b), and (c) is expressed from a nucleic acid operably linked to a regulatory sequence that is expressed in the cell. In some embodiments, one or more of components (a), (b), and (c) is introduced in a particle. In some embodiments, the particle comprises a ribonucleoprotein (RNP). In some embodiments, the cell is a prokaryotic cell. In some embodiments, the cell is a eukaryotic cell. In some embodiments, the cell is a mammalian cell, a cell of a non-human primate, or a human cell. In some embodiments, the cell is a plant cell.

In another aspect, the present disclosure provides an engineered nucleic acid targeting system for inserting a polynucleotide into a target nucleic acid, which comprises a) an engineered c2c5 protein or fragment thereof designed to form a complex with TnsBC and linked to a programmable DNA binding domain, b) a guide designed to form a complex with the programmable DNA binding domain and target the complex to the target nucleic acid, c) i) TnsA, TnsB, and TniQ, or ii) TnsB and TnsC, and d) a polynucleotide comprising a nucleic acid to be inserted flanked by right end and left end sequence elements.

In another aspect, the present disclosure provides an engineered nucleic acid targeting system for inserting a polynucleotide into a target nucleic acid, which comprises a) a component of a Cas5678f complex designed to bind to TnsABC-TniQ or to TnsABC linked to a programmable DNA binding domain, b) a guide designed to form a complex with the programmable DNA binding domain and target the complex to the target nucleic acid, c) i) TnsA, TnsB, TnsC, and TniQ, or ii) TnsA, TnsB and TnsC, and d) a polynucleotide comprising a nucleic acid to be inserted flanked by right end and left end sequence elements.

In another aspect, the present disclosure provides an method of inserting a polynucleotide into a target nucleic acid in a cell, which comprises introducing into the cell a) an engineered TnsE protein or fragment thereof designed to form a complex with TnsABC or TnsBC and linked to a programmable DNA binding domain, b) a guide designed to form a complex with the programmable DNA binding domain and target the complex to the target nucleic acid, c) i) TnsA, TnsB, and TnsC, or ii) TnsB and TnsC, and d) a polynucleotide comprising a nucleic acid to be inserted flanked by right end and left end sequence elements, wherein the guide directs cleavage of the target nucleic acid, whereby the polynucleotide is inserted.

In another aspect, the present disclosure provides a method of inserting a polynucleotide into a target nucleic acid in a cell, which comprises introducing into the cell a) an engineered c2c5 protein or fragment thereof designed to form a complex with TnsBC and linked to a programmable DNA binding domain, b) a guide designed to form a complex with the programmable DNA binding domain and target the complex to the target nucleic acid, c) i) TnsA, TnsB, and TniQ, or ii) TnsB and TnsC, and d) a polynucleotide comprising a nucleic acid to be inserted flanked by right end and left end sequence elements, wherein the guide directs cleavage of the target nucleic acid, whereby the polynucleotide is inserted.

In another aspect, the present disclosure provides a method of inserting a polynucleotide into a target nucleic acid in a cell, which comprises introducing into the cell a) a component of a Cas5678f complex designed to bind to TnsABC-TniQ or to TnsABC linked to a programmable DNA binding domain, b) a guide designed to form a complex with the programmable DNA binding domain and target the complex to the target nucleic acid, c) i) TnsA, TnsB, TnsC, and TniQ, or ii) TnsA, TnsB and TnsC, and d) a polynucleotide comprising a nucleic acid to be inserted flanked by right end and left end sequence elements.

In another aspect, the present disclosure provides an engineered nucleic acid targeting system for inserting a polynucleotide into a target nucleic acid, which comprises a) an engineered c2c5 protein or fragment thereof designed to form a complex with TnsBC and linked to a programmable DNA binding domain, b) a guide designed to form a complex with the programmable DNA binding domain and target the complex to the target nucleic acid, c) i) TniA, TniB, and TniQ, or ii) TnsB and TnsC, and TnsD, and d) a polynucleotide comprising a nucleic acid to be inserted flanked by right end and left end sequence elements.

In another aspect, the present disclosure provides a method of inserting a polynucleotide into a target nucleic acid in a cell, which comprises introducing into the cell a) a component of a Cas5678f complex designed to bind to TnsABC-TniQ or to TnsABC linked to a programmable DNA binding domain, b) a guide designed to form a complex with the programmable DNA binding domain and target the complex to the target nucleic acid, c) i) TniA, TniB, and TniQ, or ii) TnsB and TnsC, and TnsD, and d) a polynucleotide comprising a nucleic acid to be inserted flanked by right end and left end sequence elements.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

FIGS. 4A-4C. Small RNA-Seq from *Scytonema hoffmanni* UTEX 2349. FIG. 4A: Transcripts associated with c2c5 locus. FIG. 4B: Sequences of four putative tracrRNAs depicted in FIG. 4A (SEQ ID NO:1-4). FIG. 4C: Predicted folding of tracrRNA_1 with DR (SEQ ID NO:390-391).

FIGS. 6A-6B. FIG. 6A: Vectors used to generate insertions in *E. coli*. TnsB, TnsC, TniQ, and C2c5 are expressed from a pUC19 plasmid along with the endogenous tracrRNA region and a crRNA targeting FnPSP1. An R6K donor plasmid contains the t14 left and right transposon ends with a kanamycin resistance cargo gene. A pACYC target plasmid containing a 6N PAM library was used. Kanamycin resistant colonies were recovered and sequenced to identify enriched PAM motifs and insertion site locations. FIG. 6B: Target sequence of PAM library (SEQ ID NO:5-6).

FIGS. 8A-8B. Sequencing confirmation of insertion into a GTT PAM target. The t14 donor was inserted downstream of a GCTTG target site at the left end junction and this site (GCTTG) was confirmed to be duplicated at the right end junction, consistent with the known activity of wild-type Tn7 transposase. FIG. 8A: LE junction (SEQ ID NO:7-8). FIG. 8B: RE junction (SEQ ID NO:9-10).

FIG. 10A: RNA-seq from *E. coli* expressing t14_C2c5. FIG. 10B: Predicted binding between crRNA and tracrRNA 2.11 and an sgRNA design linking crRNA and tracrRNA 2.11 (SEQ ID NO:938-940).

FIG. 12A: 12 sgRNA variants were designed and tested for in vitro RNA-guided transposition activity. sgRNA nucleotide sequences are shown in Example 11. FIG. 12B: Insertion frequency of RNA-guided insertions in *E. coli*.

FIG. 12C: Predicted folding of sgRNA-10 (SEQ ID NO:11).

FIG. 13A: Schematic of the *Scytonema* hofmanni CAST locus containing Tn7-like proteins, the CRISPR-Cas effector Cas12j, and a CRISPR array. Predicted transposon ends are annotated as LE and RE. FIG. 13B: Fluorescent micrograph of the cyanobacteria *S. hofmanni*. Scale bar, 40 uM. FIG. 13C: Alignment of small RNA-Seq reads from *S. hofmanni*. The location of the putative tracrRNA is marked.

FIGS. 14A-14D. Targeting requirements for RNA-guided insertions. FIG. 14A: Schematic of experiment to test CAST system activity in *E. coli*. FIG. 14B: PAM motifs for insertions mediated by ShCAST and AcCAST. FIG. 14C: ShCAST and AcCAST insertion positions identified by deep sequencing. FIG. 14D: Insertion frequency of ShCAST system in *E. coli* with pTarget substrates as determined by ddPCR. Error bars represent s.d. from n=3 replicates.

FIG. 15A: Genetic requirement of tnsB, tnsC, tniQ, Cas12j, and tracrRNA on insertion activity. Deleted components are indicated by a dashed outline. FIG. 15B: Insertion activity of 6 tracrRNA variants expressed with the pJ23119 promoter. FIG. 15C: Schematic of tracrRNA and crRNA base pairing and two sgRNA designs highlighting the linker sequence (blue) (SEQ ID NO:12-15). FIG. 15D: Insertion activity with donor truncations of LE and RE. Predicted transposase binding sites are indicated with grey lines. For all panels, experiments were carried out in *E. coli* and insertion frequency was determined by ddPCR on extracted plasmid DNA. Error bars represent s.d. from n=3 replicates.

FIG. 16A: Schematic of in vitro transposition reactions with purified ShCAST proteins and plasmid donor and targets. FIG. 16B: RNA requirements for in vitro transposition. pInsert was detected by PCR for LE and RE junctions. All reactions contained pDonor and pTarget. Schematics indicate the location of primers and the expected product sizes for all reactions. FIG. 16C: Targeting specificity of ShCAST in vitro. All reactions contained ShCAST proteins and sgRNA. FIG. 16D: Protein requirements for in vitro transposition. All reactions contained pDonor, pTarget, and sgRNA. FIG. 16E: CRISPR-Cas effector requirements for in vitro transposition. All reactions contained ShCAST proteins, pDonor, and pTarget. FIG. 16F: Chromatograms of pInsert reaction products following transformation and extraction from *E. coli*. LE and RE elements are highlighted and the duplicated insertion sites denoted. For all panels, ShCAST proteins were used at a final concentration of 50 nM, and n=3 replicates for all reactions were performed with a representative image shown (SEQ ID NO:16-19).

FIG. 17A: Schematic of experiment to test for genome insertions in *E. coli*. FIG. 17B: Insertion frequency at 10 tested protospacers following ShCAST transformation. Insertion frequency was determined by ddPCR on extracted genomic DNA. Error bars represent s.d. from n=3 replicates. FIG. 17C: Flanking PCR of 3 tested protospacers in a population of *E. coli* following ShCAST transformation. Schematics indicate the location of primers and the expected product sizes. FIG. 17D: Insertion site position as determined by deep sequencing following ShCAST transformation. FIG. 17E: Insertion positions determined by unbiased donor detection. The location of each protospacer is annotated along with the percent of total donor reads that map to the target.

FIGS. 19A-19D. Engineering Cas9-TnpA fusions for targeted DNA transposition. FIG. 19A: Schematic of in vitro insertion reactions using TnpA fused to Cas9D10A. Reactions contained mammalian cell lysate and plasmid targets with circular ssDNA joint donor. FIG. 19B: In vitro insertions with Cas9-TnpA into a plasmid target. Insertions were detected by PCR and are dependent on donor DNA, an active transposase, and an sgRNA which exposes the TTAC insertion motif in the R-loop. FIG. 19C: Deep sequencing of in vitro reaction products with flanking primers reveals precise insertions downstream of the TTAC insertion site. LE and RE elements are annotated (SEQ ID NO:20-30). FIG. 19D: In vitro testing of TnpA family proteins from across a variety of insertion site substrates. All TnpA proteins were fused to Cas9D10A and expressed in mammalian lysate. Insertion frequency was determined using ddPCR.

FIGS. 20A-20C. CRISPR-associated transposase (CAST) systems and sequence features of TnsB, TnsC and TniQ proteins. FIG. 20A: Annotated genome maps for the two Tn7-like elements analyzed in this work. Species name, genome accession number and nucleotide coordinates are indicated. The genes are shown by block arrows indicating the direction of transcription and drawn roughly to scale. The CAST-related genes are colored. Annotated cargo genes are shown in light gray and a short description is provided according to statistically significant hits (probability>90%) from the respective HHpred searches. The number of spacers in the CRISPR arrays and the sequence of the CRISPR repeats are indicated at the right end of the schemes (SEQ ID NO:31-32). FIG. 20B: Sequence features and domain organizations of three core proteins of the CAST transposase. Proteins are shown as rectangles drawn roughly to scale. Domains are shown inside the rectangles as gray boxes based on the statistically significant hits (probability>90%) from the respective HHpred searches. The most relevant hits from the PFAM database are mapped and are shown above the respective rectangles. ShTniQ protein is compared with selected homologs from different Tn7-like elements. The catalytic motifs are indicated for ShTnsB and ShTnsC. Abbreviations: CHAT, caspase family protease; HEPN, predicted RNase of HEPN family; HTH—helix-turn-helix DNA binding domain; RHH, ribbon-helix-helix DNA binding domain; RM, restriction-modification; TPR, Tetratricopeptide repeats containing protein. FIG. 20C: Small RNA-seq reveals active expression of AcCAST CRISPR array and predicted tracrRNA.

FIG. 21A: Transformation of a library of PAMs, pDonor, and ShCAST pHelper or AcCAST pHelper into *E. coli* was used to discover PAM targeting requirements. Insertion products were selectively amplified and PAMs with detectable insertions were ranked and scored based on their log 2 enrichment score. A log 2 enrichment cutoff of 4 was used for subsequent analysis of preferred PAMs. FIG. 21B: PAM wheel interpretation of preferred PAM sequences for ShCAST and AcCAST. FIG. 21C: Validation of individual PAMs in ShCAST was performed by transformation of pHelper, pDonor, and pTarget with a defined PAM. Insertion frequency was determined by ddPCR.

FIGS. 23A-23D. Insertion site requirements for RNA-guided insertions. FIG. 23A: Schematic of insertion motif library screen. pDonor, pTarget, and pHelper are transformed into *E. coli* and insertions are enriched by PCR for subsequent sequencing analysis. FIG. 23B: 5N motifs upstream of the insertion site were ranked and scored based on their log 2 enrichment relative to the input library. The 5 bp upstream of the most abundant insertion position (62 bp) were used for analysis. A log 2 enrichment cut-off of 1 was used for subsequent analysis of preferred motifs, showing a very weak motif preference. FIG. 23C: Sequence logo of 5N preferred motifs shows minor preference for T/A nucleotides 3 bp upstream of the insertion site. FIG. 23D: Motif wheel interpretation of identified preferred motif sequences.

FIG. 24A: Sequence of ShCAST transposon ends highlighting short and long repeat motifs (SEQ ID NO:38-39). FIG. 24B: Alignment of ShCAST repeat motifs and the canonical Tn7 TnsB binding sequence (SEQ ID NO:40-49).

FIGS. 25A-25D. In vitro reconstitution of an RNA-guided transposase. FIG. 25A: Coomassie stained SDS-PAGE gel of purified ShCAST proteins. FIG. 25B: Temperature dependence of in vitro transposition activity of ShCAST. FIG. 25C: In vitro reactions in the absence of ATP and $MgCl_2$. FIG. 25D: In vitro cleavage reactions with Cas9 and Cas12j on pTargetGGTT. Buffer 1: NEB CutSmart, buffer 2: NEB 1, buffer 3: NEB 2, buffer 4: Tn7 reaction buffer.

FIG. 26A: Screening for insertions at 48 target sites in the E. coli genome by nested PCR for LE junctions. FIG. 26B: Re-streaking E. coli that were transformed with pHelpers with genome-targeting sgRNA and pDonor demonstrates the ability to recover clonal populations of bacteria with the insertion product of interest.

FIG. 30A shows a schematic of a 134 bp double-strand DNA substrate for in vitro transposases reactions. The transposase TnpA from *Helicobacter pylori* IS608 inserts single-stranded DNA 5' to TTAC sites (SEQ ID NO:50). FIG. 30B shows a schematic of constructs for expression in mammalian cells. TnpA from IS608 functions as a dimer and constructs were made fusing a monomer of TnpA to Cas9-D10A (TnpA-Cas9), a tandem dimer of TnpA fused to Cas9-D10A (TnpAx2-Cas9), or free TnpA alone. XTEN16 and XTEN32 are protein linkers of 16 and 32 amino acids respectively. FIG. 30C shows insertion of foreign DNA with mammalian cell lysates containing TnpA. In vitro reactions with the 134 bp substrate in panel a, synthesized sgRNA, and lysates from mammalian cells expressing the indicated constructs. The provided donor included in all reactions is a 200 bp circular ssDNA molecule containing the left and right hairpins of IS608 and 90 bp foreign internal DNA. PCR E1 amplifies the complete substrate, while the insertion-specific PCRs, E2 and E3, contain one flanking primer and one primer specific to the donor sequence. The observed products are consistent with donor insertion and match the predicted sizes of 183 bp (E2), and 170 bp (E3). The inability to detect a 334 bp band in the total reaction, or in PCR E1 suggests that the overall rate of insertion is low. PCRs E2 and E3 indicate donor insertion when TnpA is present in any lysate which is independent of sgRNA. FIG. 30D shows NGS sequencing of E2 products indicating the insertion site of donor DNA. Non-specific integration by TnpA occurs at all possible integration sites in the array indicated by peaks 4 bp apart. Incubation with TnpAx2-Cas9-D10A lysate led to the targeted integration of single-strand DNA 5' to positions 15 and 19 bp from the PAM in a manner that was dependent on presence and target site of guide RNA (SEQ ID NO:51).

FIG. 31A shows a schematic of a 280 bp double-strand DNA substrate for in vitro transposases reactions cloned into pUC19. The substrate contains two array of TTACx6 TnpA insertion sites, one which is targeted by Cas9 sgRNAs. Plasmid substrates were treated with T5 exonuclease to remove contaminating single-strand DNA. FIG. 31B shows insertion of foreign DNA with mammalian cell lysates containing TnpA. In vitro reactions with the 280 bp substrate in panel a, synthesized sgRNA, and lysates from mammalian cells expressing the indicated constructs. The donor DNA is a 160 bp circular ssDNA molecule containing the left and right hairpins of IS608 and 90 bp foreign DNA. PCR E1 amplifies the complete substrate, while the insertion-specific PCRs, E2 and E3, contain one flanking primer and one primer specific to the donor sequence. A 250 bp PCR product is detectable after incubation with $TnpA_{IS608\ x2}$-$Cas9_{D10A}$, but not TnpA alone, and is dependent on the presence of donor and sgRNA. FIG. 31C shows purification of recombinant $TnpA_{IS608\ x2}$-$Cas9_{D10A}$ from E. coli which matches. Coomassiestained SDS-PAGE showing two dilutions of purified protein. FIG. 31D shows comparison of in vitro DNA insertions using mammalian cell lysates versus purified protein. In vitro reactions with the 280 bp substrate in panel a, synthesized sgRNA, and lysates from mammalian cells expressing the indicated constructs or purified protein from panel c. The donor DNA was a 160 bp circular ssDNA molecule containing the left and right hairpins of IS608 and 90 bp foreign DNA. PCR E1 amplified the complete substrate, while the insertion-specific PCRs, E2 and E3, contained one flanking primer and one primer specific to the donor sequence. E2 products of 250 bp were weakly visible upon addition of $TnpA_{IS608\ x2}$-$Cas9_{D10A}$ lysate and protein while PCR E3 detected more robust insertion products. The darker band at 152 bp was consistent with directed insertions to the Cas9-targeted TTAC array in contrast to the 240 bp band, predicted to be the size for non-targeted insertions at the second TTAC array. The 152 bp E3 insertion-specific PCR products were dependent on donor DNA and sgRNA.

FIG. 32 shows a schematic demonstrating an exemplary method. Cas9 was used to expose a single-stranded DNA substrate. A HUH transposase was tethered to insert single-stranded DNA. The opposing strand was nicked and allowed to fill-in DNA synthesis.

FIG. 37 shows a schematic and expression of new fusions of TnpA-Cas9 fusions from a variety of bacterial species. $GGS_{32}$ and $XTEN_{32}$ are polypeptide linkers. ISHp608 from

*Helicobacter pylori*, ISCbt1 from *Clostridium botulinum*, ISNsp2 from *Nostoc* sp., ISBce3 from *Bacillus cereus*, IS200G from *Yersinia pestis*, ISMma22 from *Methanosarcina mazei*, IS1004 from *Vibrio* chloerae. Experiments with Substrate 1 revealed insertion products with TnpA alone which may have resulted from single-stranded DNA contamination of the substrate. A second plasmid substrate (Substrate 2) was constructed with two arrays of six TTAC insertion sites. Single-stranded DNA was removed by T5 exonuclease digestion.

FIG. 38 shows in vitro insertion reactions. Substrate 2 was incubated with the indicated mammalian cell lysates, a 160 bp circular single-stranded DNA donor, and sgRNA1. PCR E2 detects insertion events which are predicted to be 247 bp in size.

FIG. 39 shows SDS-PAGE of TnpA-Cas9 purified protein (left, two dilutions shown). In vitro reactions with mammalian cell lysate and purified protein both reveal insertion events dependent on donor and sgRNA. +$^{lin}$ donor denotes a linear donor.

Figure 40:
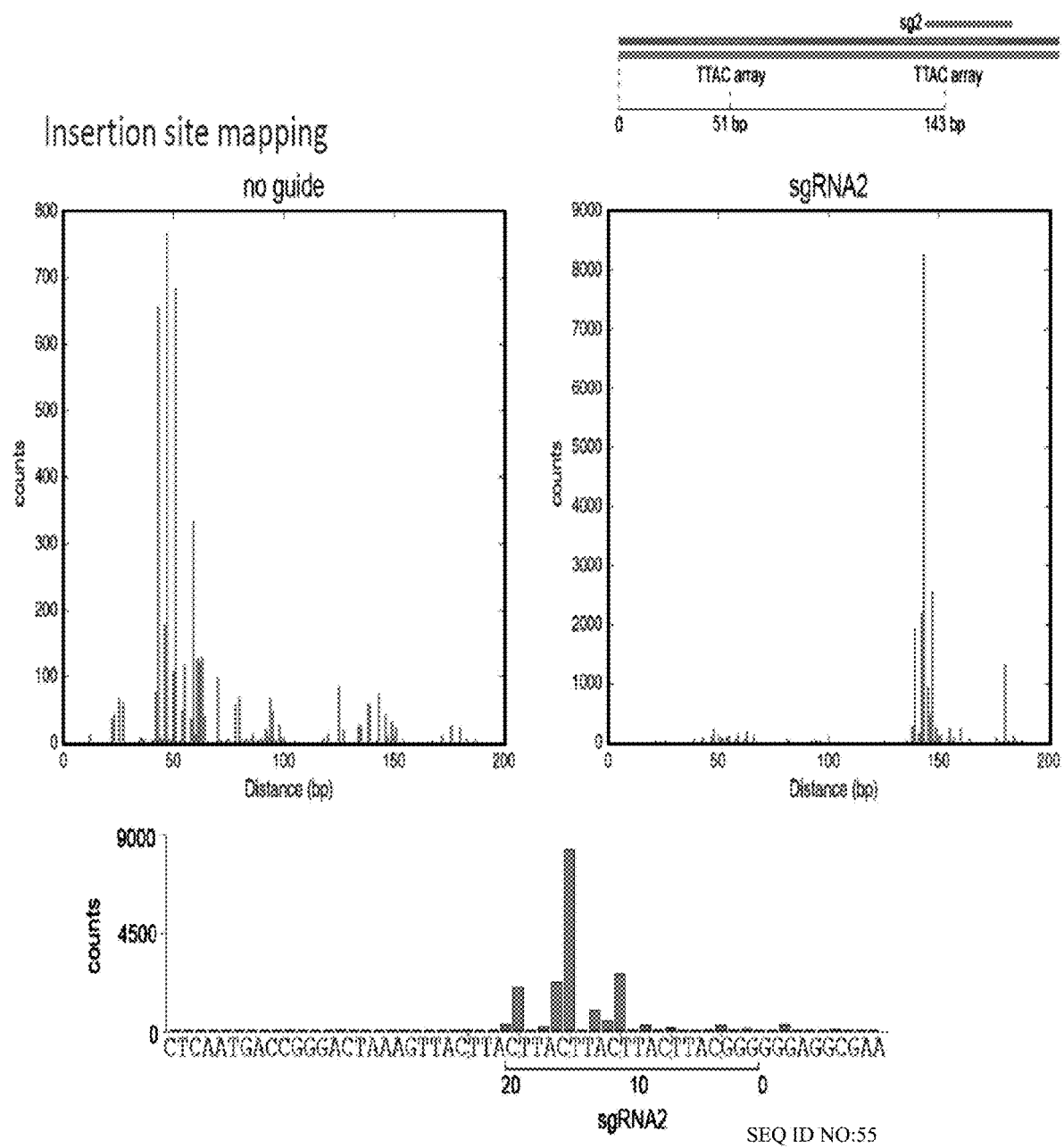

FIG. 40 shows NGS of the insertion sites from the highlighted reactions in slide 12. Low levels of insertion were detected throughout the array in the absence of guide. Addition of sgRNA2 resulted in targeted insertions within the guide sequence, most prominently at position 16 from the PAM (SEQ ID NO:55).

FIG. 41 shows a plasmid substrate (Substrate 3) with insertions sites recognized by different TnpA orthologs. In vitro reactions with mammalian lysates, a 160 bp circular single-stranded DNA donor, and sgRNAs. TnpA from IS608 inserts after TTAC sequence and targeting other regions of the substrate does not result in detectable insertions.

FIGS. 42A-42G. Targeting requirements for CRISPR-associated transposase (CAST) systems. FIG. 42A. Schematic of the *Scytonema hofmanni* CAST locus containing Tn7-like proteins, the CRISPR-Cas effector Cas12k, and a CRISPR array. FIG. 42B. Fluorescent micrograph of the cyanobacteria *S. hofmanni*. Scale bar, 40 uM (SEQ ID NO:56). FIG. 42C. Alignment of small RNA-Seq reads from *S. hofmanni*. The location of the putative tracrRNA is marked. FIG. 42D. Schematic of experiment to test CAST system activity in *E. coli* (SEQ ID NO:941). FIG. 42E. PAM motifs for insertions mediated by ShCAST and AcCAST. FIG. 42F. ShCAST and AcCAST insertion positions identified by deep sequencing. FIG. 42G. Insertion frequency of ShCAST system in *E. coli* with pTarget substrates as determined by ddPCR. Error bars represent s.d. from n=3 replicates.

Figure 43A:
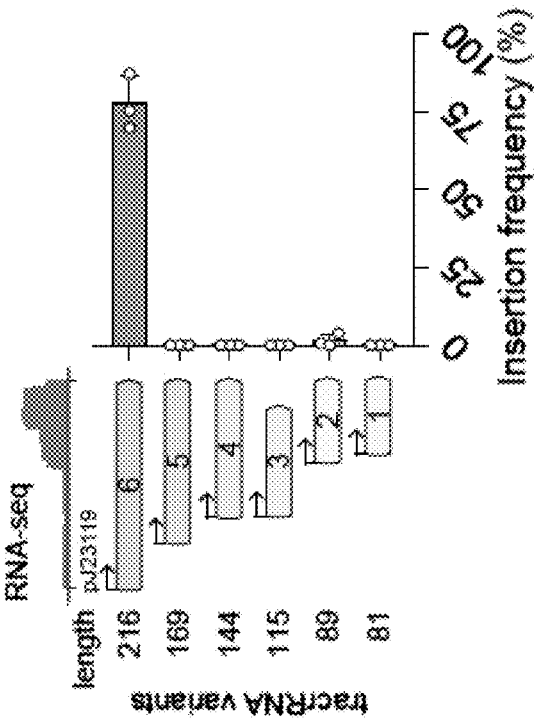
Figure 43B:
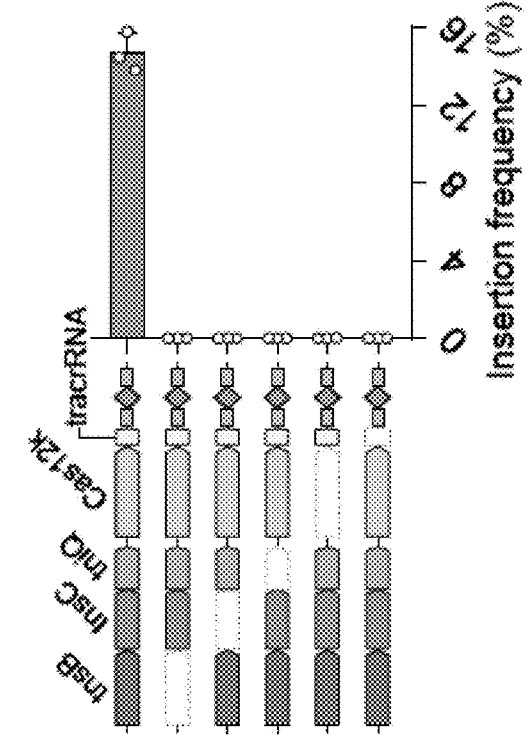
Figure 43C:
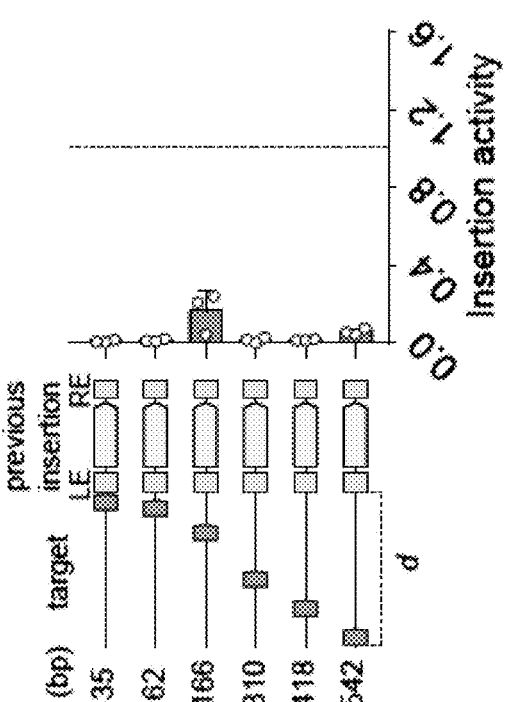
Figure 43D:
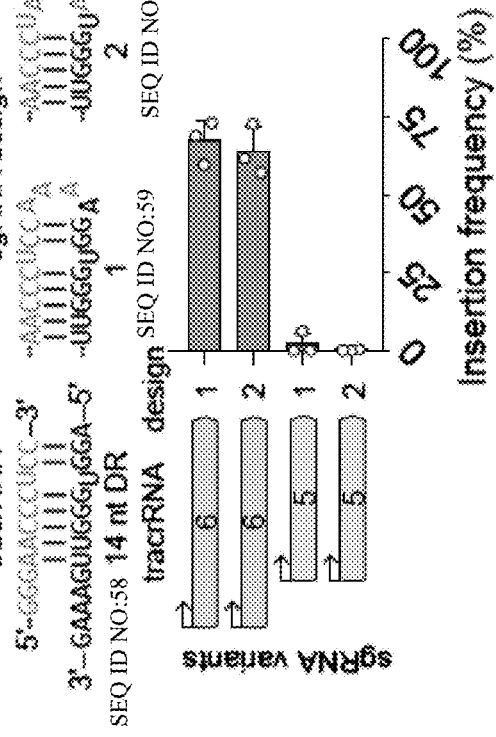

FIGS. 43A-43D. Genetic requirements for RNA-guided insertions FIG. 43A. Genetic requirement of tnsB, tnsC, tniQ, Cas12k, and tracrRNA on insertion activity. Deleted components are indicated by a dashed outline. FIG. 43B. Insertion activity of 6 tracrRNA variants expressed with the pJ23119 promoter. FIG. 43C. Schematic of tracrRNA and crRNA base pairing and two sgRNA designs highlighting the linker sequence (blue) (SEQ ID NO:57-60). FIG. 43D. Insertion activity into pTarget containing ShCAST transposon ends relative to activity into pTarget without previous insertion.

FIGS. 44A-44F. In vitro reconstitution of an RNA-guided transposase. FIG. 44A. Schematic of in vitro transposition reactions with purified ShCAST proteins and plasmid donor and targets. FIG. 44B. RNA requirements for in vitro transposition. pInsert was detected by PCR for LE and RE junctions. All reactions contained pDonor and pTarget. Schematics indicate the location of primers and the expected product sizes for all reactions.

FIG. 44C. Targeting specificity of ShCAST in vitro. All reactions contained ShCAST proteins and sgRNA. FIG. 44D. Protein requirements for in vitro transposition. All reactions contained pDonor, pTarget, and sgRNA. FIG. 44E. CRISPR-Cas effector requirements for in vitro transposition. All reactions contained ShCAST proteins, pDonor, and pTarget. FIG. 44F. Chromatograms of pInsert reaction products following transformation and extraction from *E. coli*. LE and RE elements are highlight and the duplicated insertion sites denoted. For all panels, ShCAST proteins were used at a final concentration of 50 nM, and n=3 replicates for all reactions were performed with a representative image shown (SEQ ID NO:61-64).

FIGS. 45A-45E. ShCAST mediates genome insertions in *E. coli*. FIG. 45A. Schematic of experiment to test for genome insertions in *E. coli*. FIG. 45B. Insertion frequency at 10 tested protospacers following ShCAST transformation. Insertion frequency was determined by ddPCR on extracted genomic DNA. Error bars represent s.d. from n=3 replicates. FIG. 45.C Flanking PCR of 3 tested protospacers in a population of *E. coli* following ShCAST transformation. Schematics indicate the location of primers and the expected product sizes. FIG. 45D. Insertion site position as determined by deep sequencing following ShCAST transformation. FIG. 45E. Insertion positions determined by unbiased donor detection. The location of each protospacer is annotated along with the percent of total donor reads that map to the target.

Figure 46:
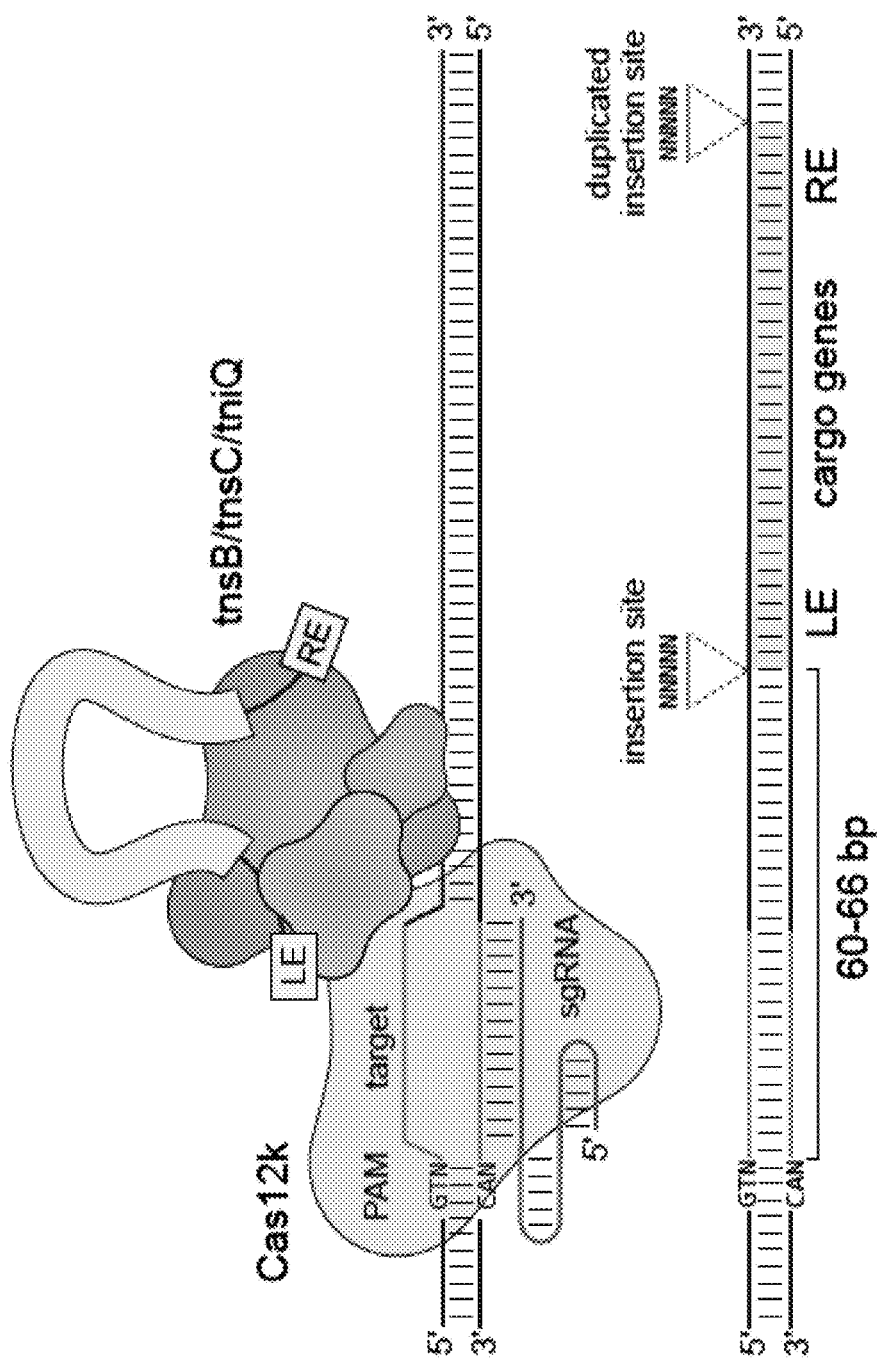

FIG. 46. Model for RNA-guided DNA transposition. The ShCAST complex that consists of Cas12k, TnsB, TnsC, and TniQ mediates insertion of DNA 60-66 bp downstream of the PAM. Transposon LE and RE sequences along with any additional cargo genes are inserted into DNA resulting in the duplication of 5 bp insertion sites.

FIGS. 47A-47F. Engineering Cas9-TnpA fusions for targeted DNA transposition. FIG. 47A. Schematic of in vitro insertion reactions using TnpA fused to Cas9D10A. Cas9 binding creates an R-loop and exposes a window of ssDNA that is accessible to the ssDNA-specific transposase TnpA (16, 36). TnpA from Heliocobacter *pylori* was fused to Cas9D10A which nicks the target strand with the hypothesis that host-repair machinery would fill-in the opposite strand of the inserted ssDNA donor. Reactions were performed with HEK293T cell lysate and plasmid targets with circular ssDNA RE-LE joint donor intermediates. FIG. 47B. In vitro insertions with Cas9-TnpA into a plasmid target. Insertions were detected by PCR and are dependent on donor DNA, an active transposase, and an sgRNA which exposes the TTAC insertion motif in the R-loop. Mutation of TnpA-Y127 has previously been shown to abolish transposase activity (17). FIG. 47C. Deep sequencing of in vitro reaction products with flanking primers reveals precise insertions downstream of the TTAC insertion site. LE and RE elements are annotated (SEQ ID NO:65-75). FIG. 47D. In vitro testing of TnpA family proteins from across a variety of insertion site substrates. All TnpA proteins were fused to Cas9¬D10A and expressed in HEK293T cells. Insertion frequency was determined using ddPCR, n=4 replicates. FIG. 47E. Schematic of a reporter plasmid in *E. coli* with a split beta-lactamase gene. The DNA donor was placed adjacent to the plasmid origin to be on the lagging DNA strand during replication to promote donor excision. Insertion of LE-ampR89-268-RE into the target site generates a functional resistance gene and insertion frequency was determined by counting the number of resistant colonies. Resistant colonies were Sanger sequenced which revealed correct insertion into the target site (8 tested). FIG. 47F. Insertion frequency of TnpA-Cas9 in *E. coli* as measured by ampicillin resistant colonies. n=4 replicates.

FIGS. 48A-48C. CRISPR-associated transposase (CAST) systems and sequence features of TnsB, TnsC and TniQ proteins. FIG. 48A. Annotated genome maps for the two Tn7-like elements analyzed in this work. Species name, genome accession number and nucleotide coordinates are indicated. The genes are shown by block arrows indicating the direction of transcription and drawn roughly to scale. The CAST-related genes are colored. Annotated cargo genes are shown in light gray and a short description is provided according to statistically significant hits (probability>90%) from the respective HHpred searches. The number of spacers in the CRISPR arrays and the sequence of the CRISPR repeats are indicated at the right end of the schemes (SEQ ID NO:942-943). FIG. 48B. Sequence features and domain organizations of three core proteins of the CAST transposase. Proteins are shown as rectangles drawn roughly to scale. Domains are shown inside the rectangles as gray boxes based on the statistically significant hits (probability>90%) from the respective HHpred searches. The most relevant hits from the PFAM database are mapped and are shown above the respective rectangles. ShTniQ protein is compared with selected homologs from different Tn7-like elements. The catalytic motifs are indicated for ShTnsB and ShTnsC. Abbreviations: CHAT, caspase family protease; HEPN, predicted RNase of HEPN family; HTH—helix-turn-helix DNA binding domain; RHH, ribbon-helix-helix DNA binding domain; RM, restriction-modification; TPR, Tetratricopeptide repeats containing protein. FIG. 48C. Small RNA-seq reveals active expression of AcCAST CRISPR array and predicted tracrRNA.

Figure 49A:
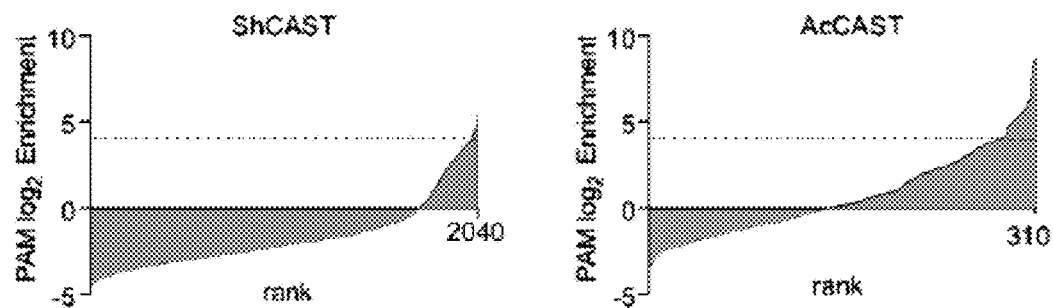
Figure 49B:
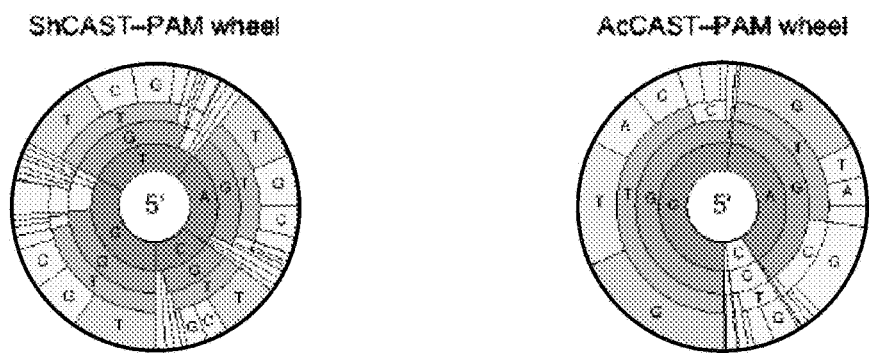
Figure 49C:
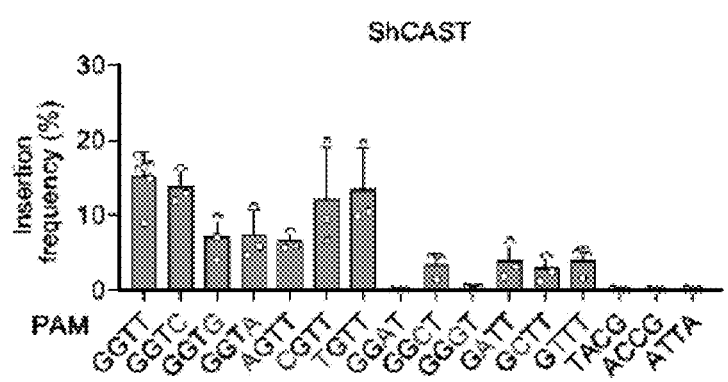

FIGS. 49A-49C. Targeting requirements for RNA-guided insertions. FIG. 49A. Transformation of a library of PAMs, pDonor, and ShCAST pHelper or AcCAST pHelper into *E. coli* was used to discover PAM targeting requirements. Insertion products were selectively amplified and PAMs with detectable insertions were ranked and scored based on their log 2 enrichment score. A log 2 enrichment cutoff of 4 was used for subsequent analysis of preferred PAMs. FIG. 49B. PAM wheel interpretation of preferred PAM sequences for ShCAST and AcCAST. FIG. 49C. Validation of individual PAMs in ShCAST was performed by transformation of pHelper, pDonor, and pTarget with a defined PAM. Insertion frequency was determined by ddPCR.

Figure 50:
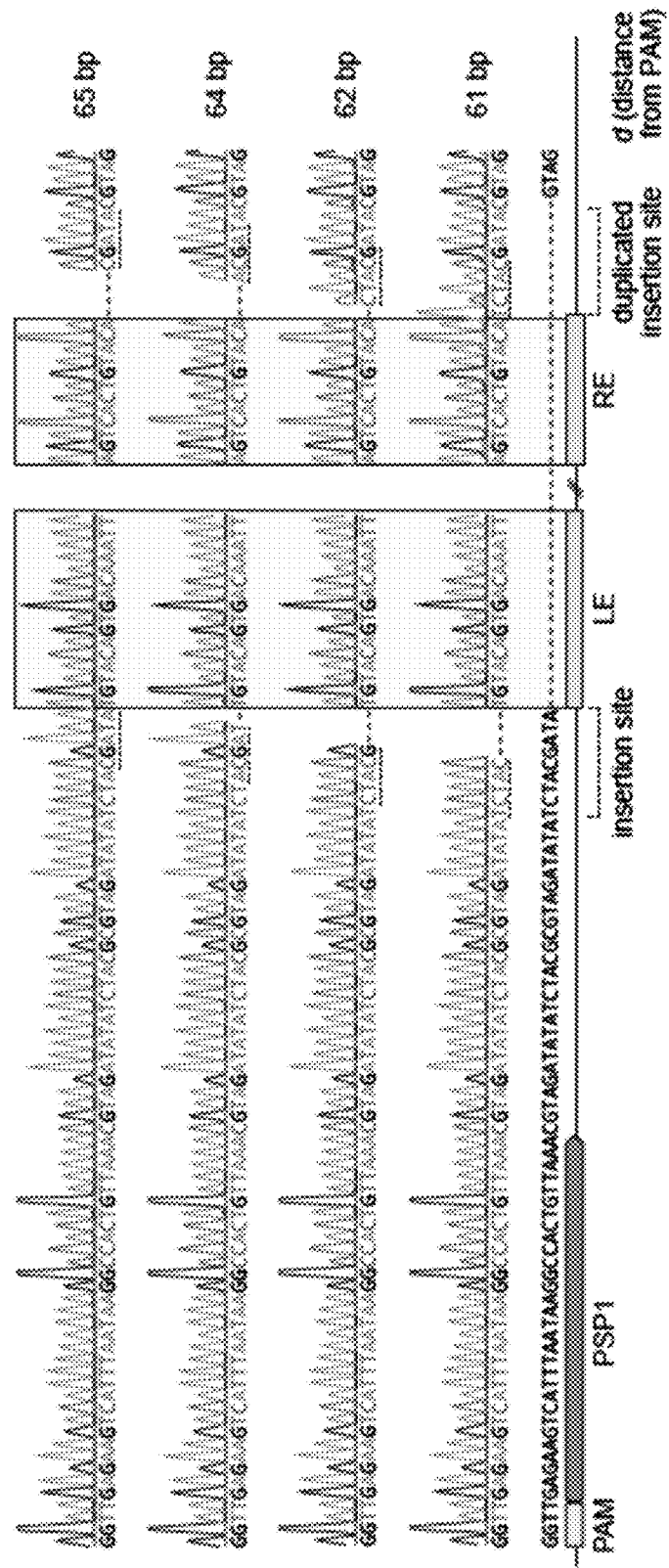

FIG. 50. Sanger sequencing of targeted insertion products in *E. coli*. Plasmid DNA from *E. coli* transformed with pHelper, pDonor, and pTargetGGTT was re-transformed into *E. coli* and Sanger sequenced verified. The duplicated insertion site is underlined in each trace (SEQ ID NO:76-80).

FIGS. 51A-51D. Insertion site requirements for RNA-guided insertions. FIG. 51A. Schematic of insertion motif library screen. pDonor, pTarget, and pHelper are transformed into *E. coli* and insertions are enriched by PCR for subsequent sequencing analysis. FIG. 51B. 5N motifs upstream of the insertion site were ranked and scored based on their log 2 enrichment relative to the input library. The 5 bp upstream of the most abundant insertion position (62 bp) were used for analysis. A log 2 enrichment cut-off of 1 was used for subsequent analysis of preferred motifs, showing a very weak motif preference. FIG. 51C. Sequence logo of 5N preferred motifs shows minor preference for T/A nucleotides 3 bp upstream of the insertion site. FIG. 51D. Motif wheel interpretation of identified preferred motif sequences.

Figure 52A:
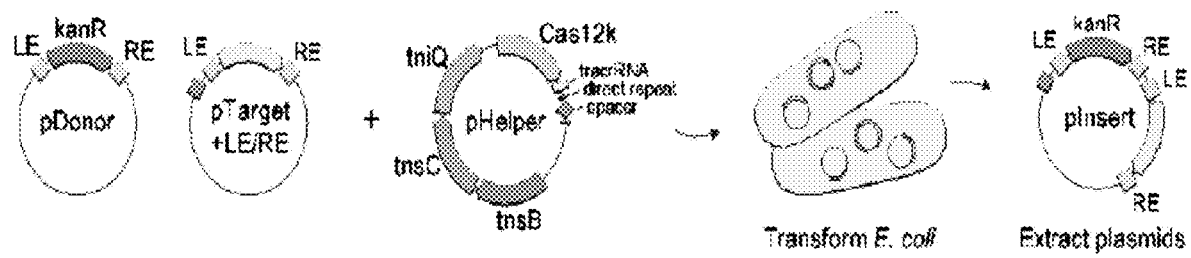
Figure 52B:
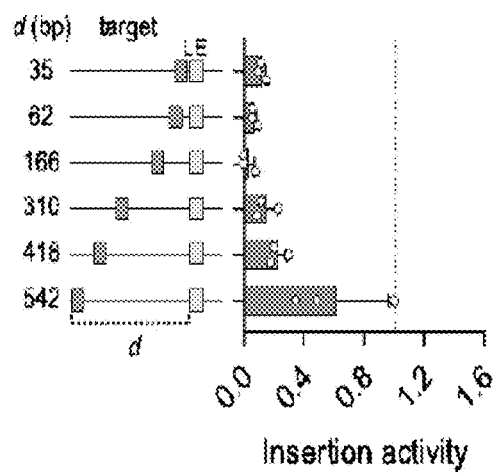
Figure 52C:
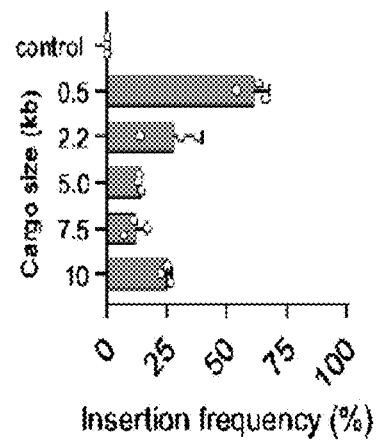
Figure 52D:
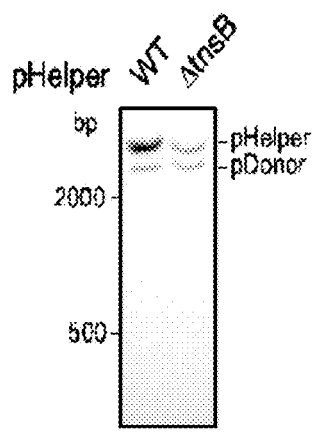
Figure 52E:
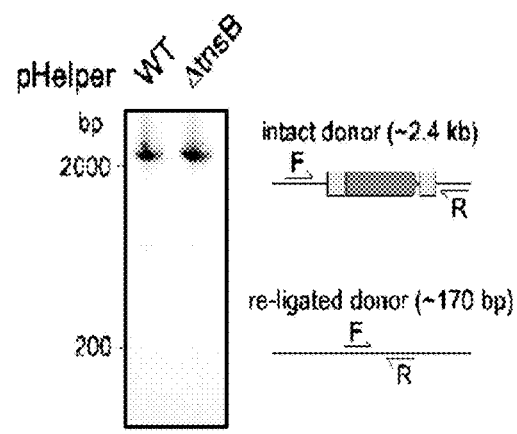

FIGS. 52A-52E. Transposition properties of ShCAST. FIG. 52A. Schematic of plasmid insertion assay targeting a plasmid containing ShCAST transposon ends. FIG. 52B. Insertion activity into pTarget containing ShCAST transposon LE. Insertion activity for each target is defined as the ratio of insertion frequency into pTarget containing ShCAST transposon LE to frequency into pTarget with no transposon ends. FIG. 52C. Insertion frequency of ShCAST into pTarget with different donor cargo sizes. Cargo size includes transposon ends. FIG. 52D. Re-ligation of pDonor after transposition cannot be detected in harvested plasmids from *E. coli* targeting PSP49 with and without tnsB. FIG. 52E. Re-ligated donor is undetectable by PCR in harvested plasmids from *E. coli* targeting PSP49.

Figure 53A:
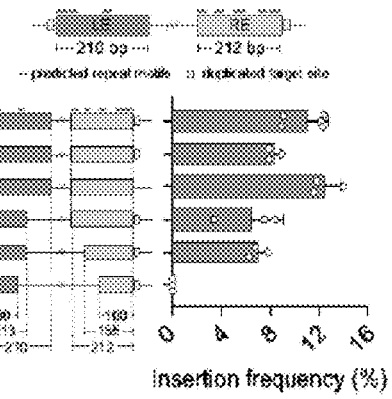
Figure 53B:
Figure 53C:
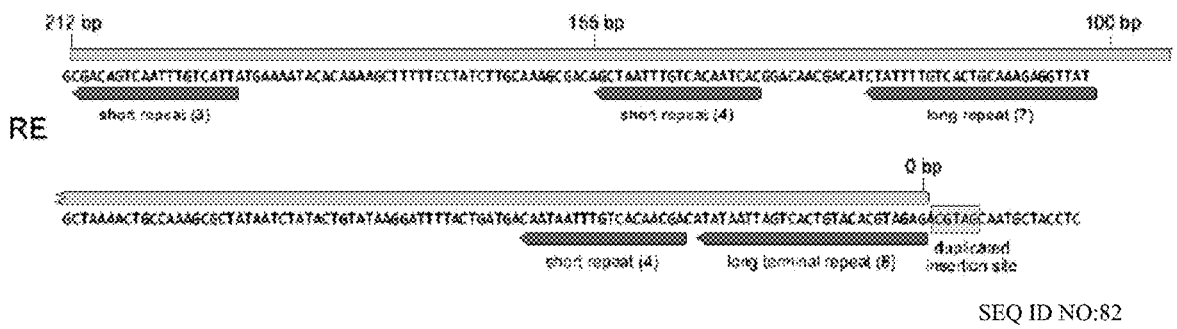

FIGS. 53A-53C. ShCAST transposon ends sequence analysis. FIG. 53A. Insertion activity with donor truncations of LE and RE. Predicted transposase binding sites are indicated with grey lines. For all panels, experiments were carried out in *E. coli* and insertion frequency was determined by ddPCR on extracted plasmid DNA. Error bars represent s.d. from n=3 replicates. FIG. 53B. Sequence of ShCAST transposon ends highlighting short and long repeat motifs (SEQ ID NO:81-82). FIG. 53C. Alignment of ShCAST repeat motifs and the canonical Tn7 TnsB binding sequence (SEQ ID NO:83-92).

FIGS. 54A-54D. In vitro reconstitution of an RNA-guided transposase. FIG. 54A. Coomassie stained SDS-PAGE gel of purified ShCAST proteins. FIG. 54B. Temperature dependence of in vitro transposition activity of ShCAST. FIG. 54C. In vitro reactions in the absence of ATP and MgCl2. FIG. 54D. In vitro cleavage reactions with Cas9 and Cas12k on pTargetGGTT. Buffer 1: NEB CutSmart, buffer 2: NEB 1, buffer 3: NEB 2, buffer 4: Tn7 reaction buffer.

Figure 55A:
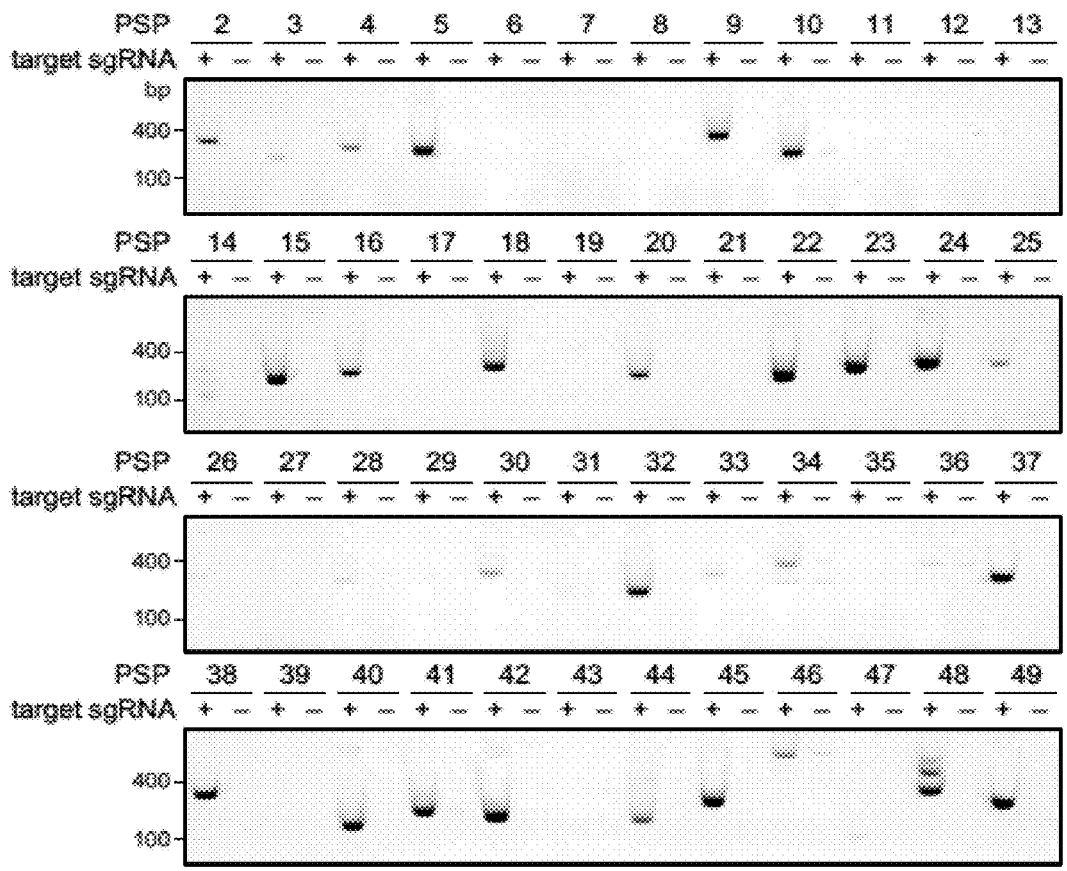
Figure 55B:
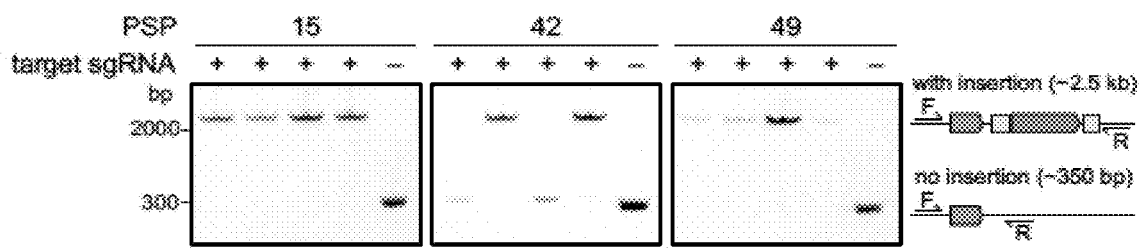
Figure 55C:
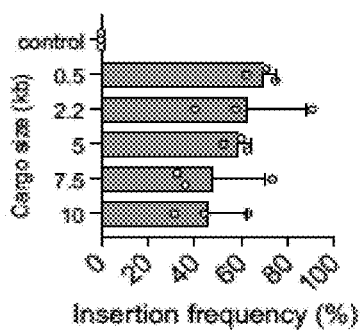

FIGS. 55A-55C. ShCAST mediates genome insertions in *E. coli*. FIG. 55A. Screening for insertions at 48 target sites in the *E. coli* genome by nested PCR for LE junctions. FIG. 55B. Re-streaking *E. coli* that were transformed with pHelpers with genome-targeting sgRNA and pDonor demonstrates the ability to recover clonal populations of bacteria with the insertion product of interest. FIG. 55C. Genome insertion frequency of pDonor containing multiple cargo sizes using pHelper with sgRNA targeting PSP42.

FIGS. 56A-56C. Sequence analysis of *E. coli* genome insertions. FIG. 56A. Targeted amplification of genomic insertions and deep sequencing to identify position of insertions. FIG. 56B. Off-target insertion reads for pHelper targeting the genome. Proximal genes for the most abundant guide-independent off targets are labelled. Identified guide-dependent off-targets are highlighted in red. FIG. 56C. Alignment of PSP42 and identified guide dependent off-target spacer (SEQ ID NO:93-94).

Figure 57:
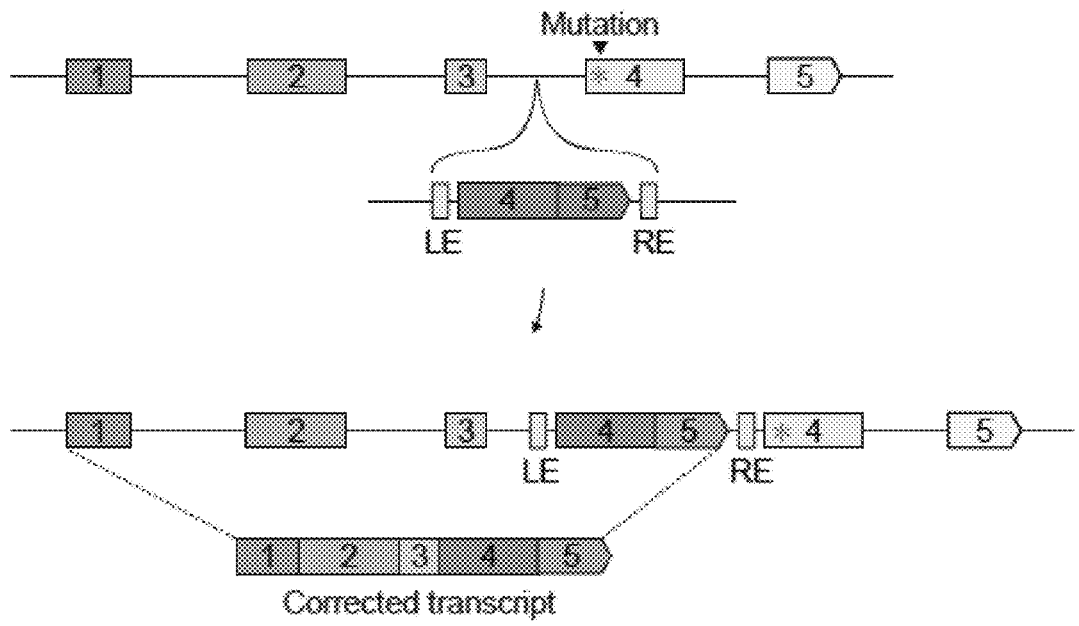

FIG. 57. Potential strategy for CAST-mediated gene correction. Replacement of a mutation-containing exon by targeted DNA insertion.

Figure 58:
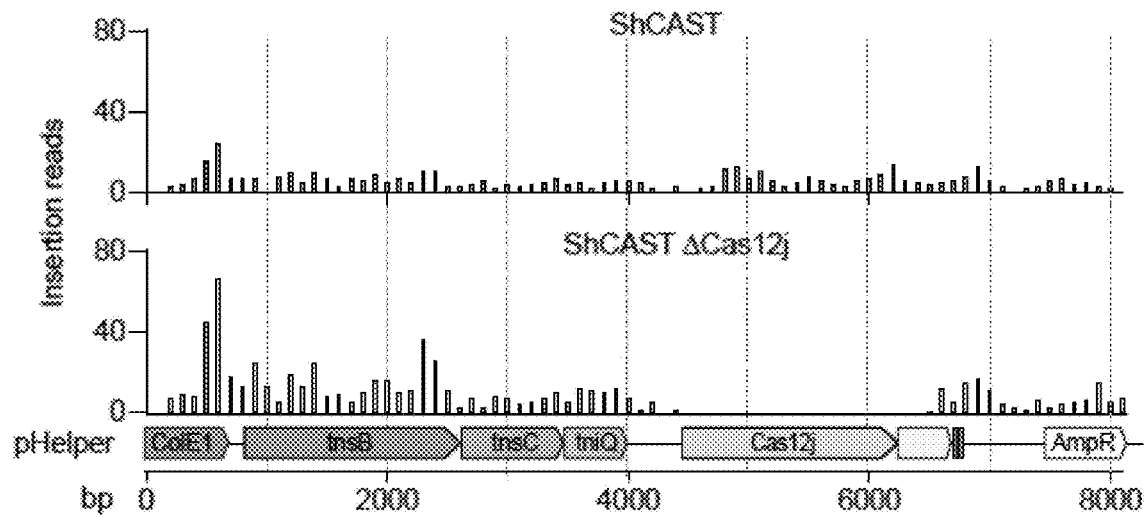

FIG. 58. ShCAST insertions into plasmids were independent of Cas12k. Sequence analysis of insertions into pHelper with wildtype ShCAST and a non-targeting sgRNA and ShCAST with Cas12k deleted.

Figure 59A:
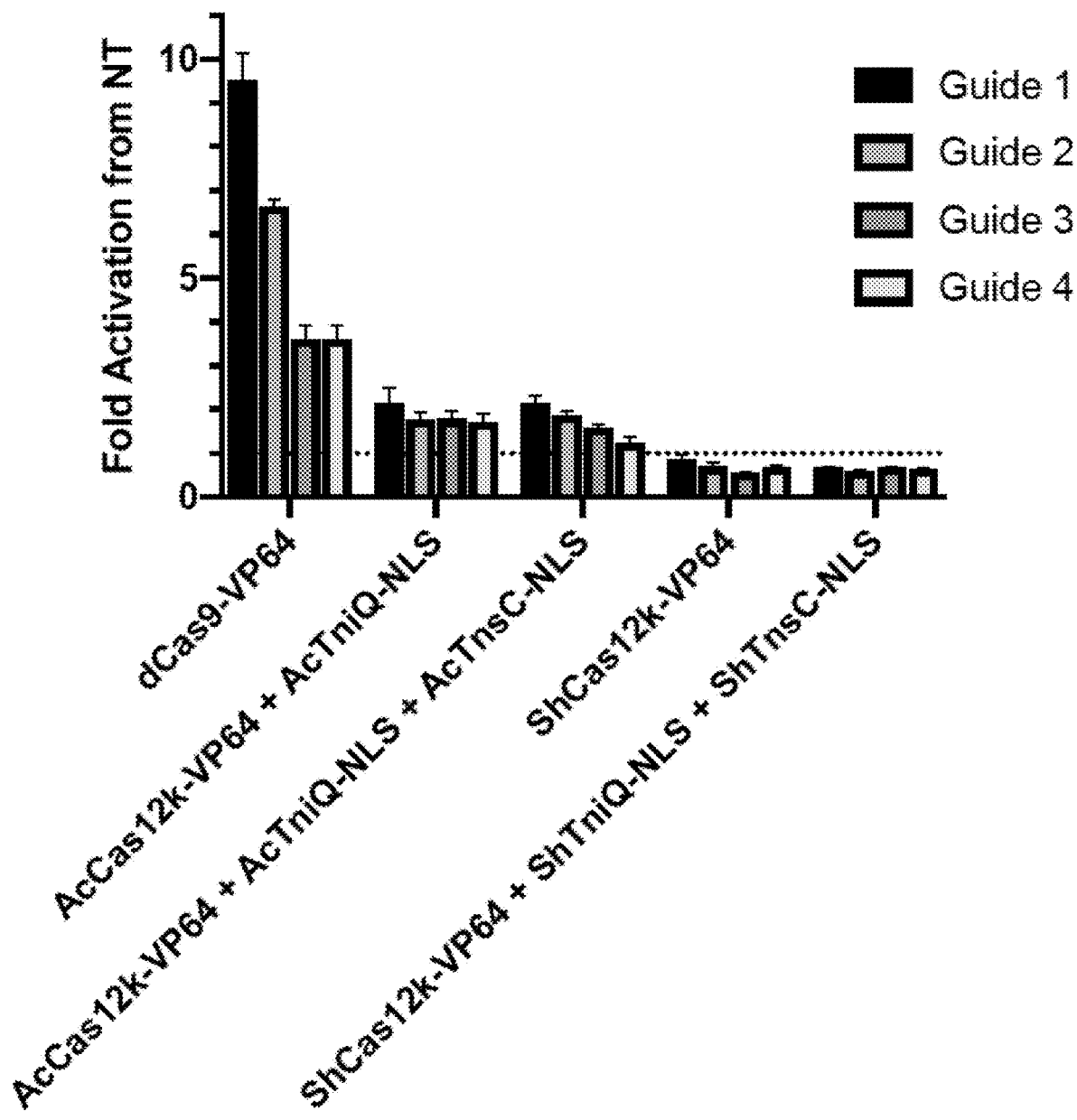
Figure 59B:
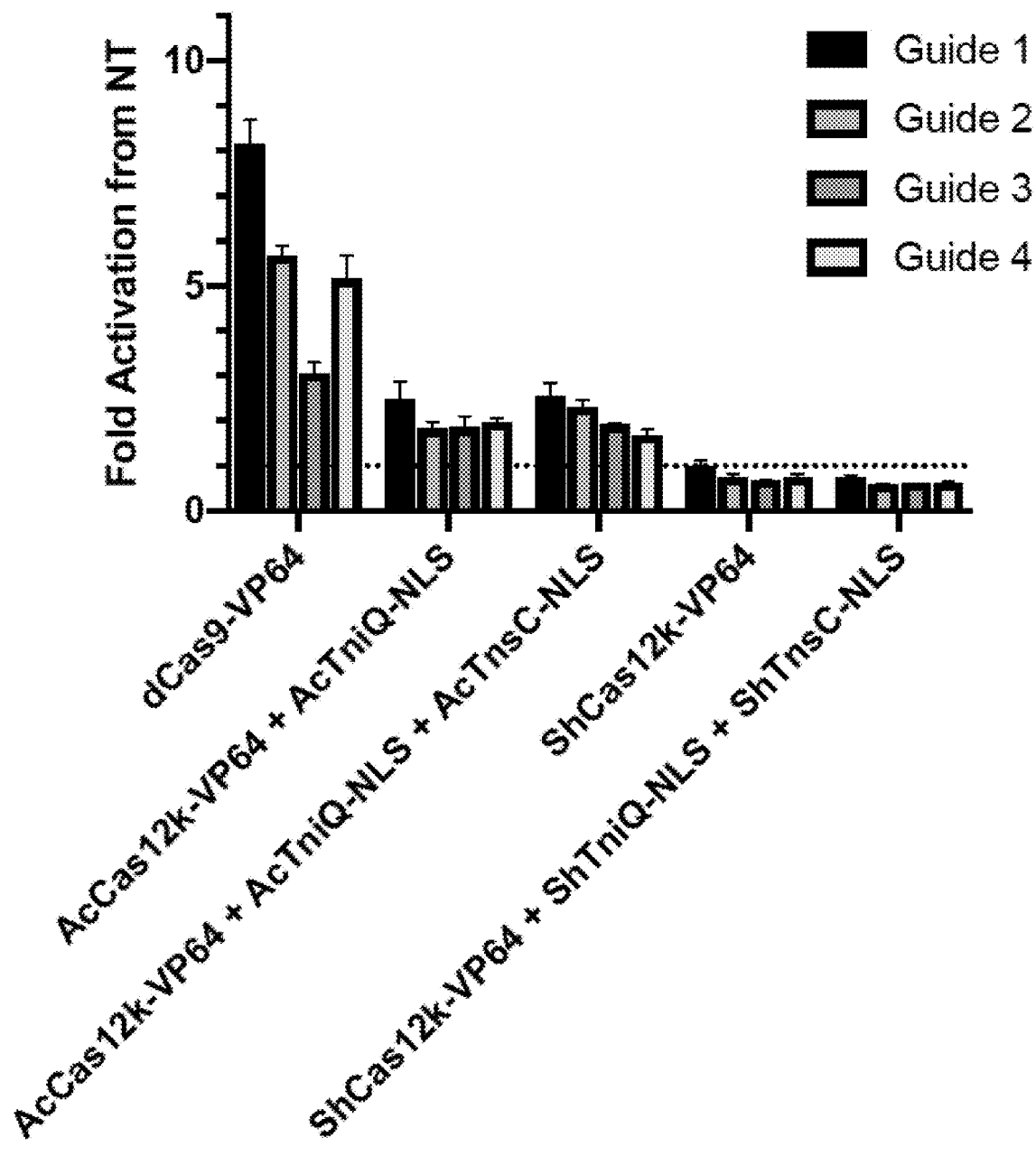

FIGS. 59A-59B show binding of Cas12k orthologs with DNA in 293HEK cells at different time points: Day 2 (FIG. 59A), and Day 3 (FIG. 59B).

Figure 60:
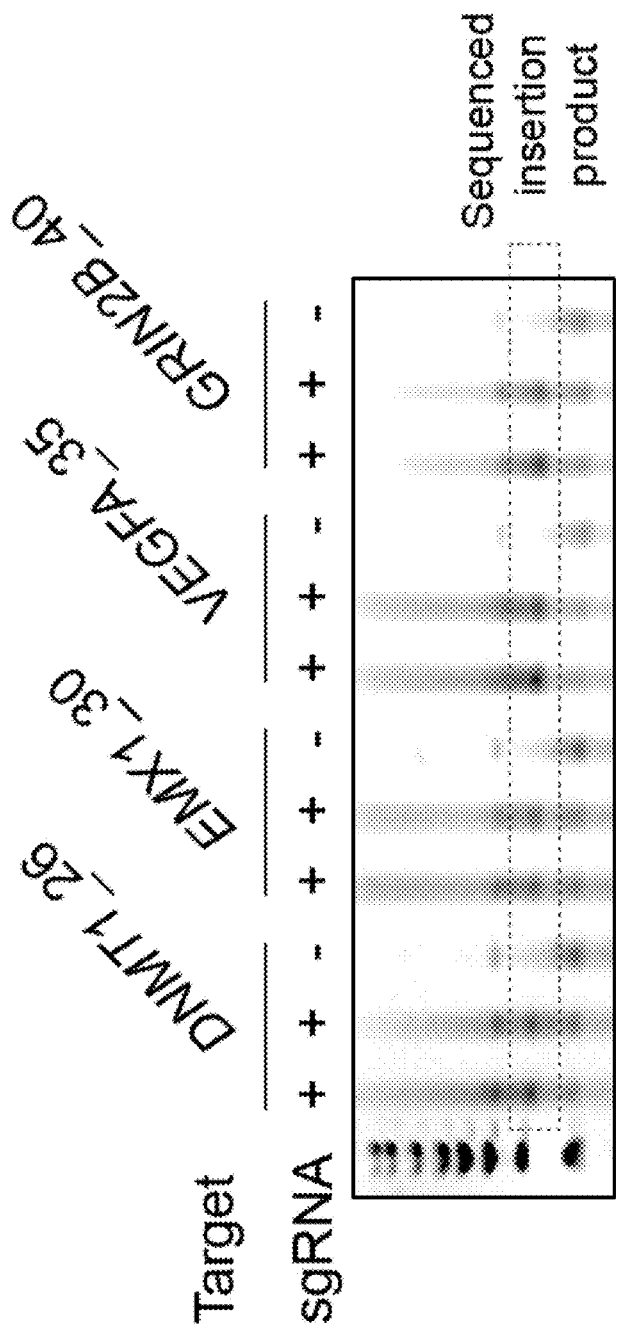

FIG. 60 shows insertion products in the targets (DNMT1, EMX1, VEGFA, GRIN2B).

Figure 61A:
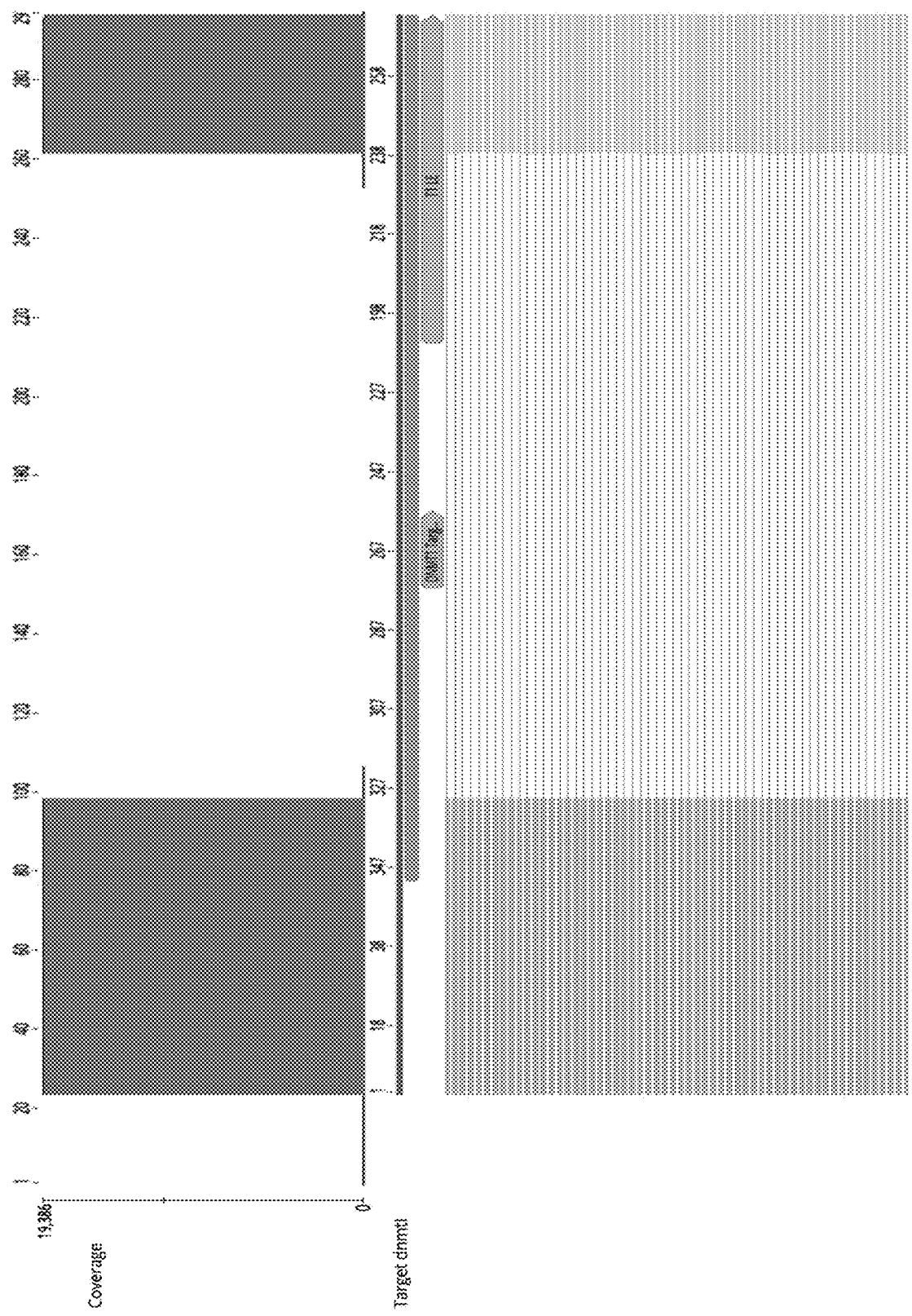
Figure 61B:
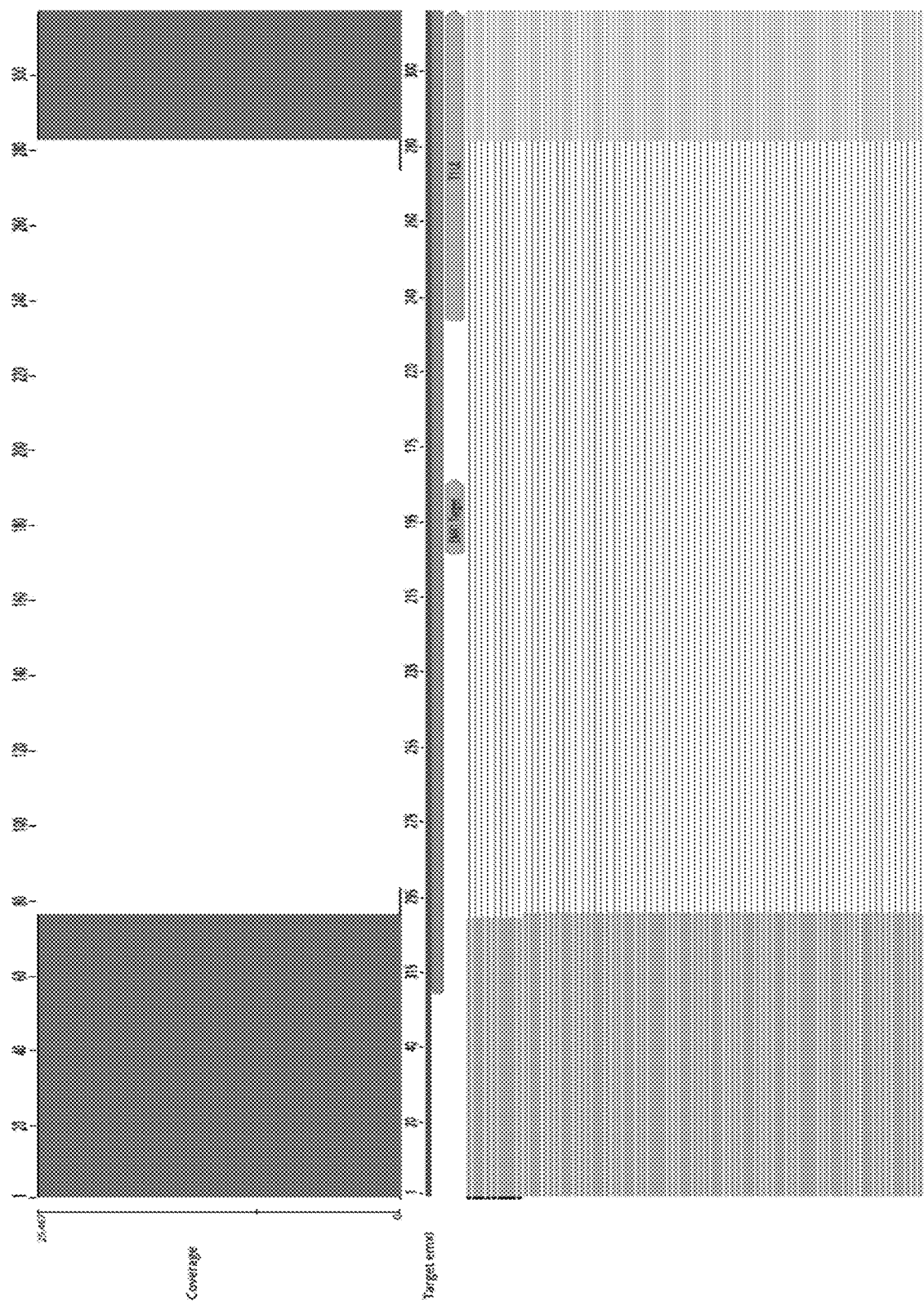
Figure 61C:
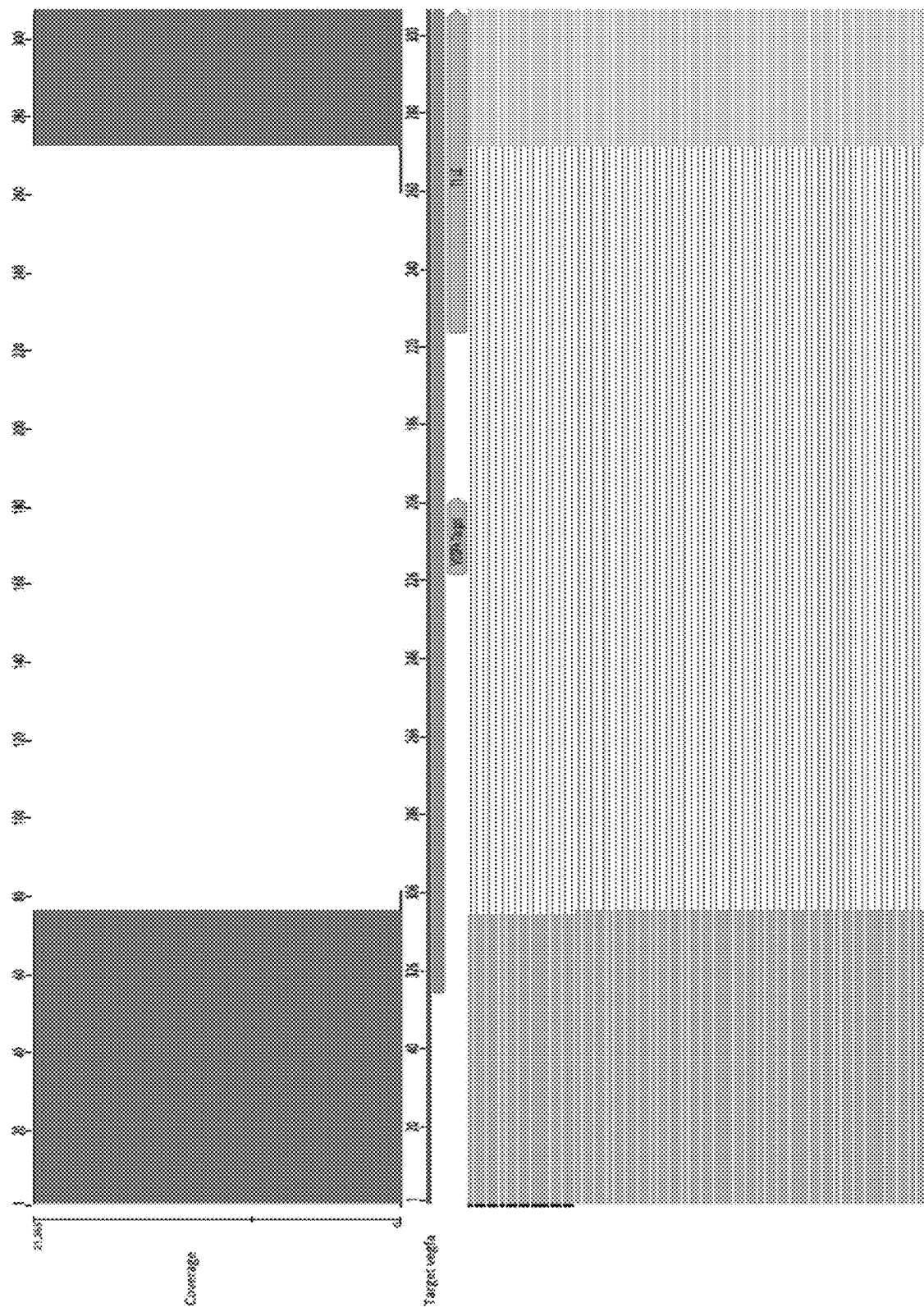
Figure 61D:
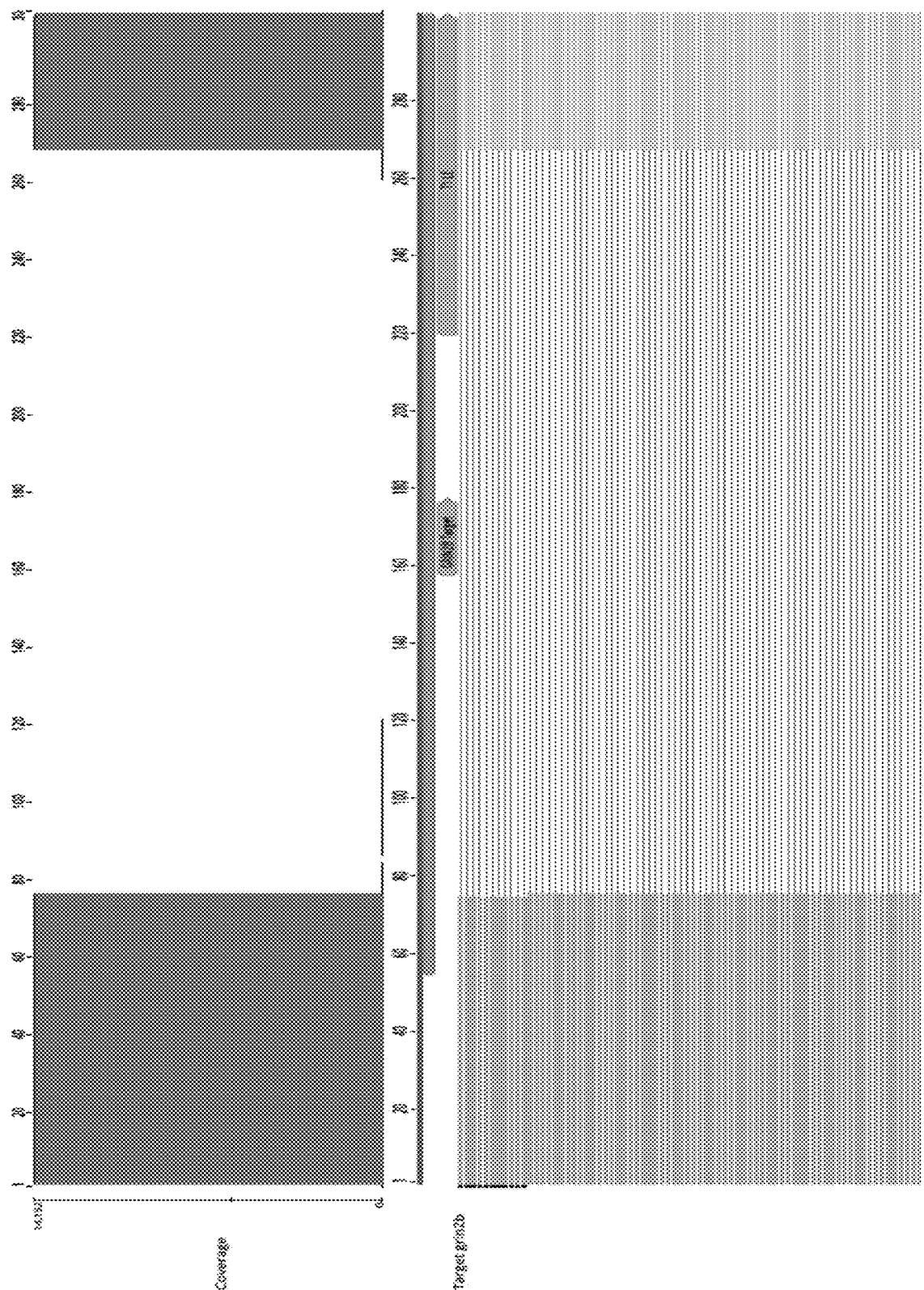

FIGS. 61A-61D show mapping of the reads to the estimated insertion product for DNMT1 (FIG. 61A), EMX1 (FIG. 61B), VEGFA (FIG. 61C), and GRIN2B (FIG. 61D).

Figure 62:
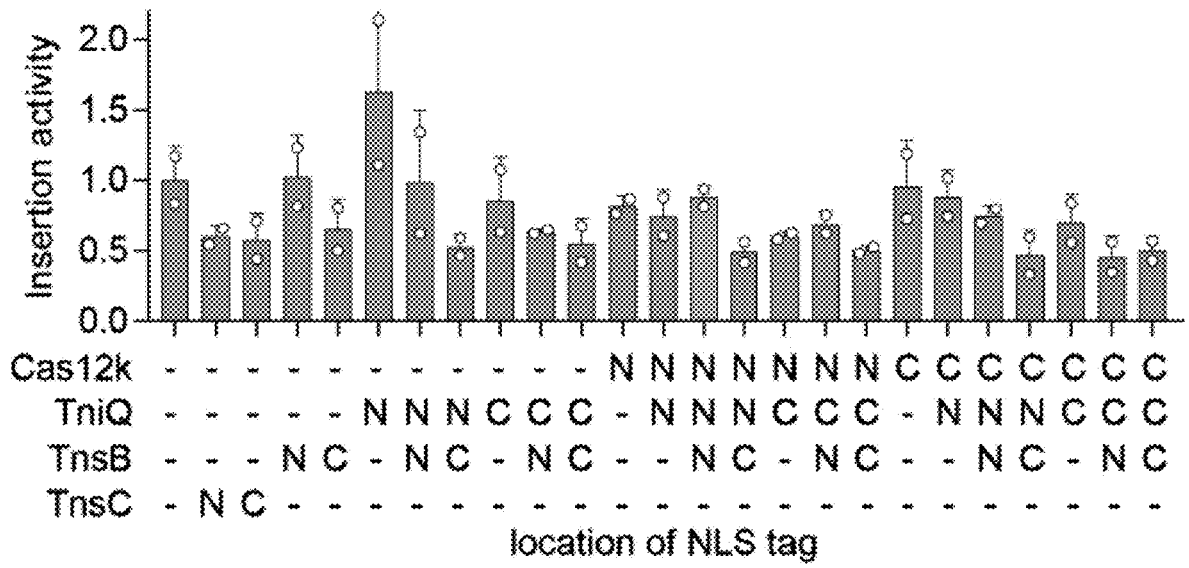

FIG. 62 shows insertion results of Cas12k, TniQ, TnsB, and TnsC with NLS tags.

Figure 63:
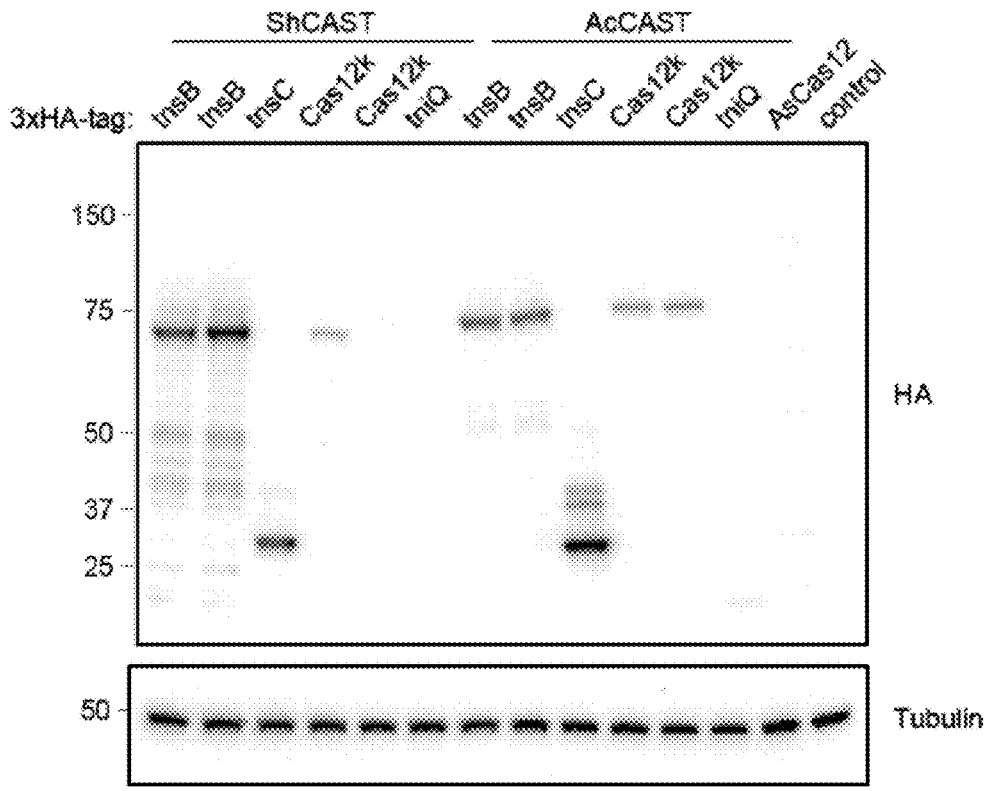

FIG. 63 shows in vitro activities in human cell lysates for each component of exemplary CASTs.

Figure 64:
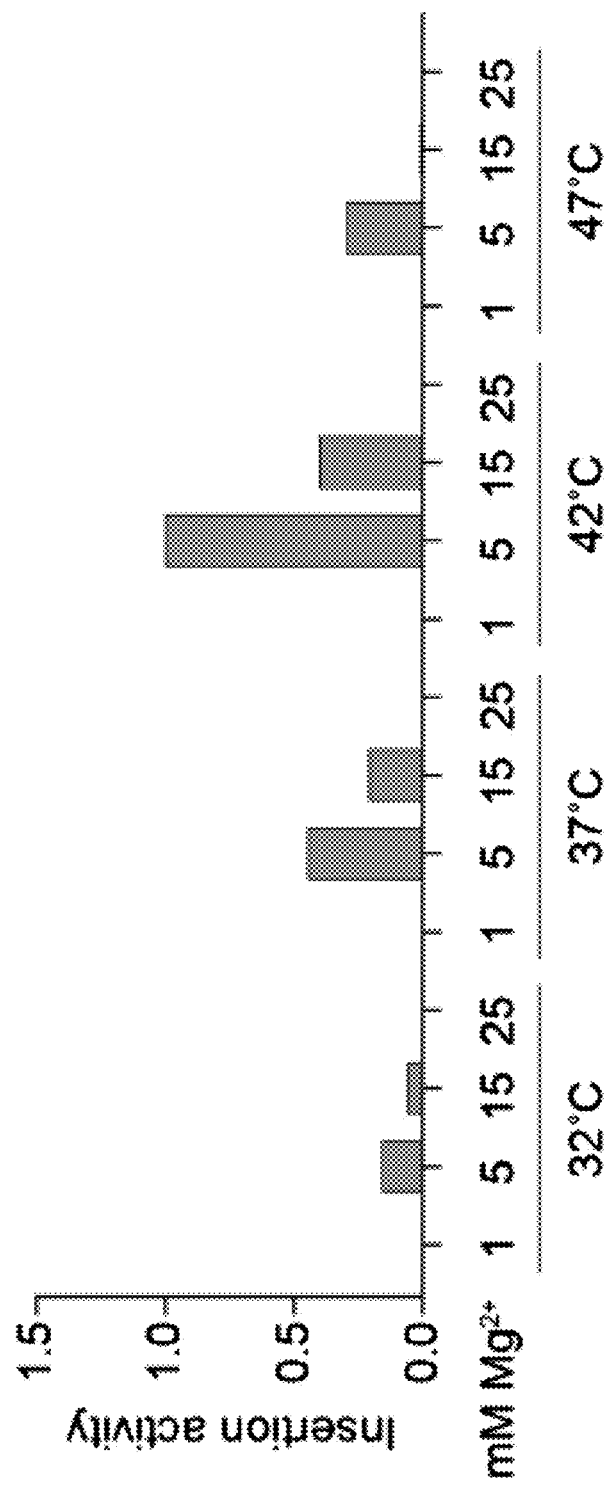

FIG. 64 shows that exemplary wildtype ShCASTs had preference of certain concentrations of magnesium.

Figure 65:
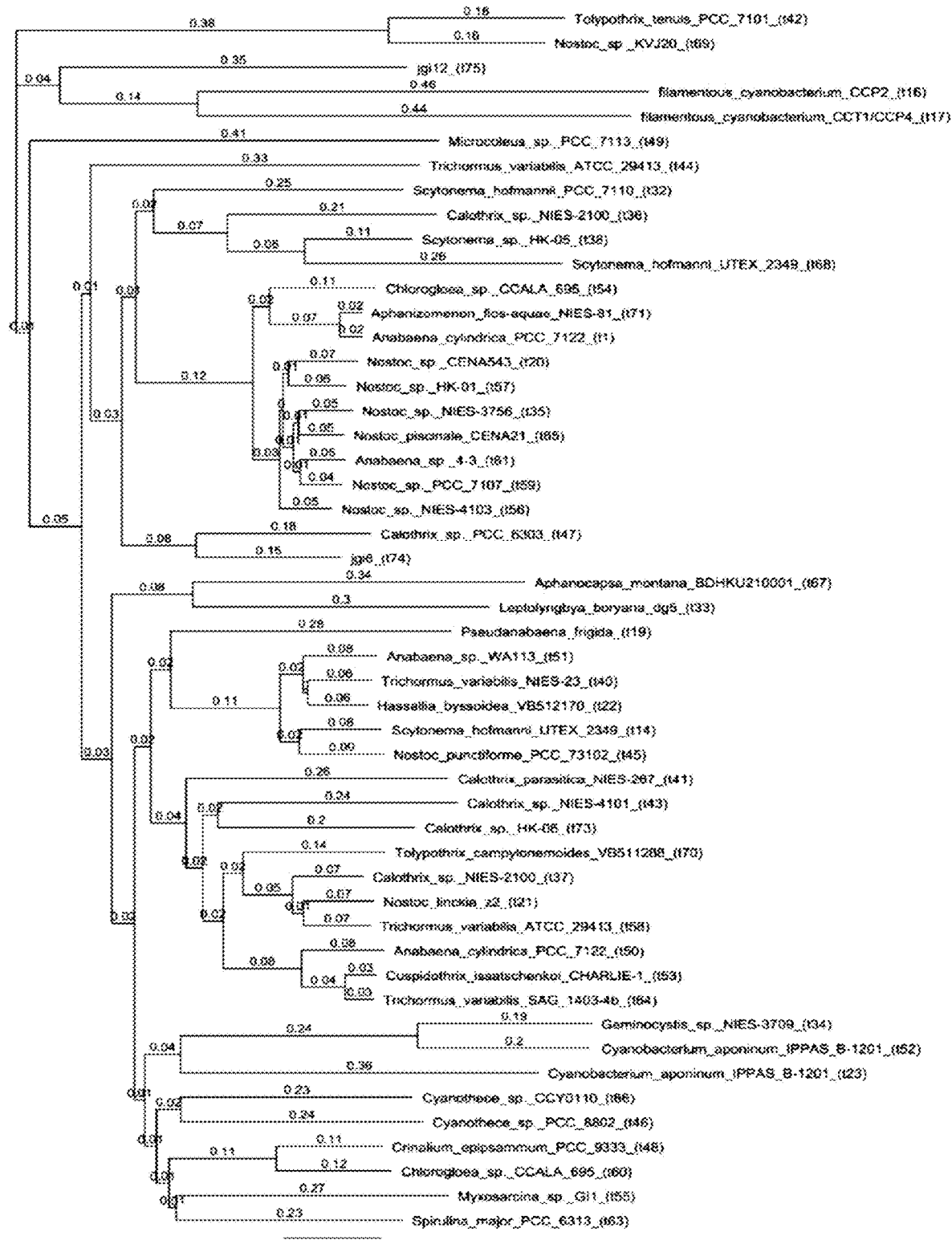

FIG. 65 shows candidate CAST systems identified by bioinformatic analysis.

Figure 66:
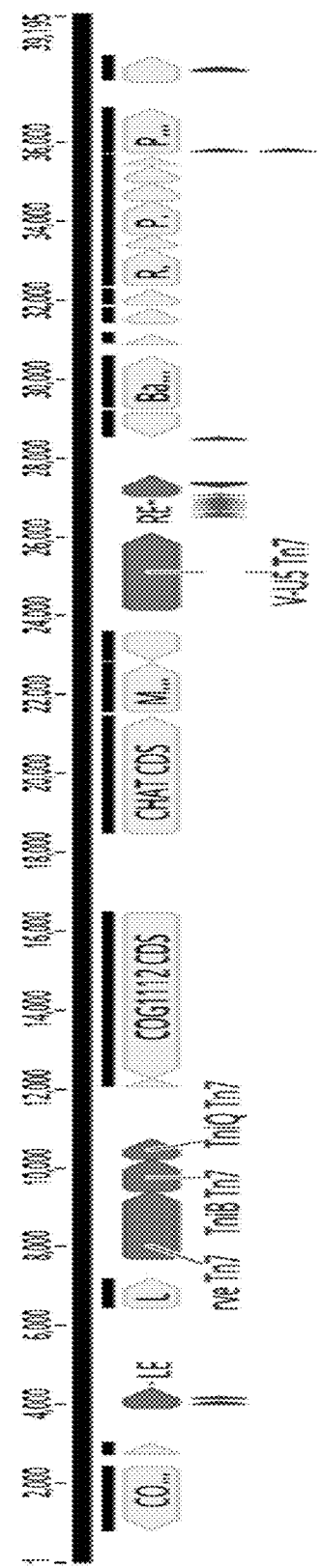

FIG. 66 shows an example of CAST system with annotations.

Figure 67:
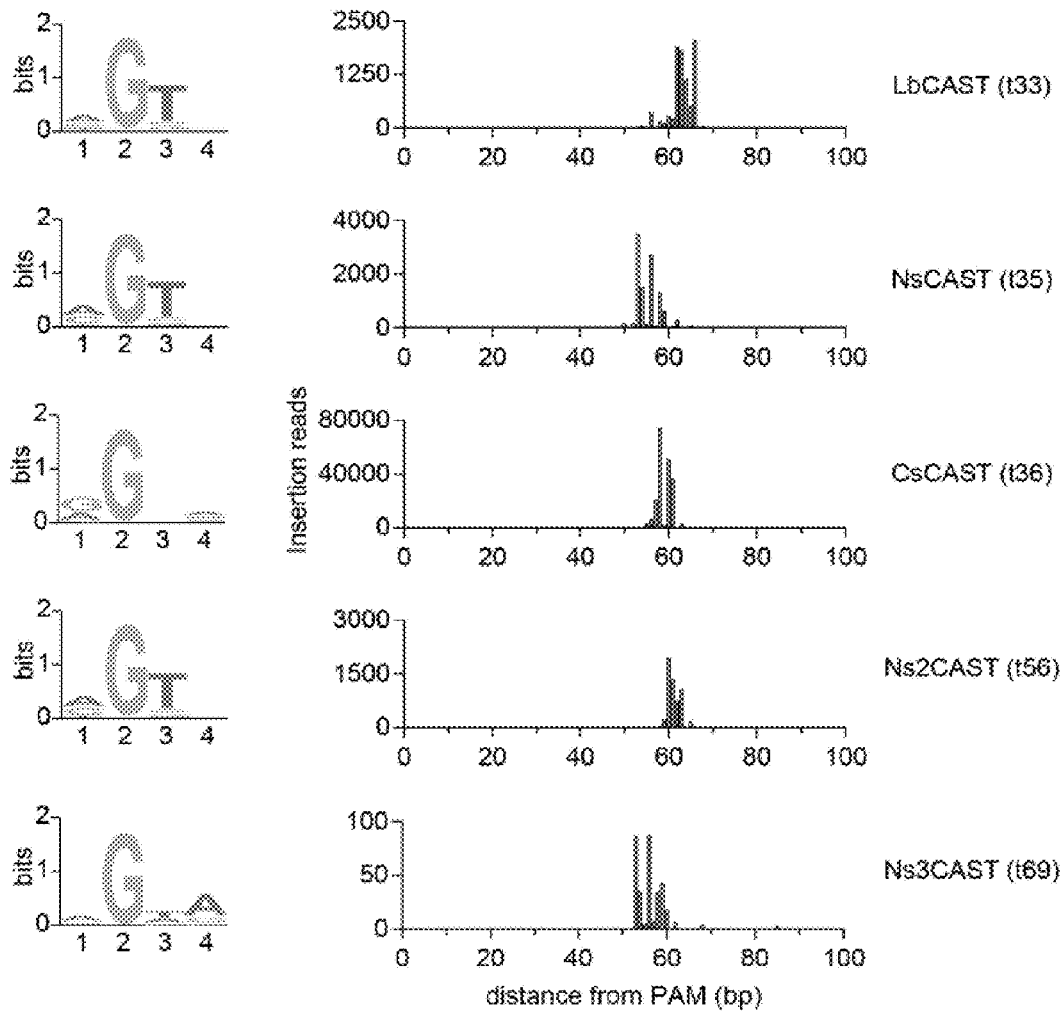

FIG. 67 shows exemplary CAST systems tested for general NGTN PAM preference and insertions downstream of protospacers.

Figure 68:
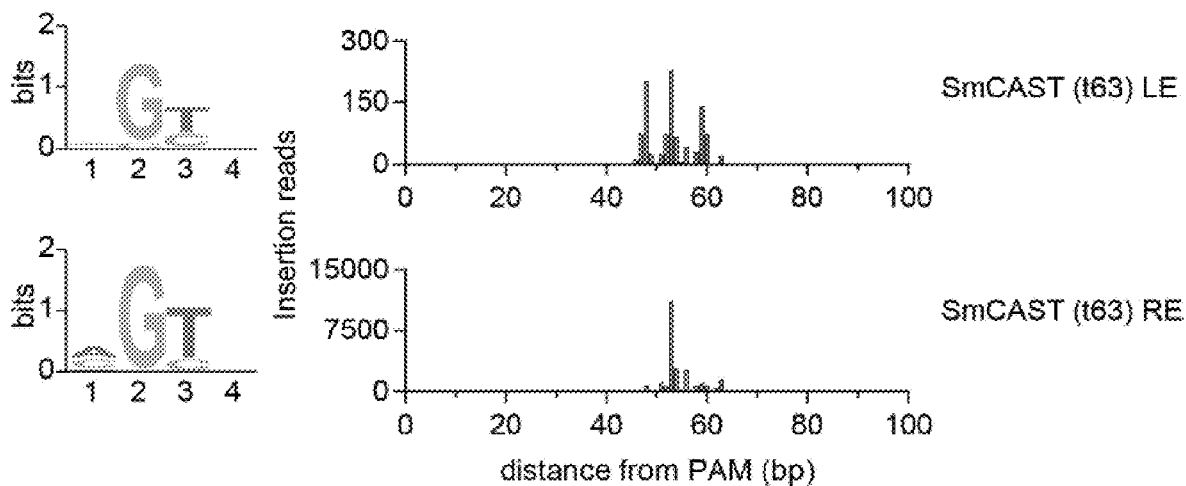

FIG. 68 shows exemplary CAST systems that exhibited bidirectional insertions.

Figure 69:
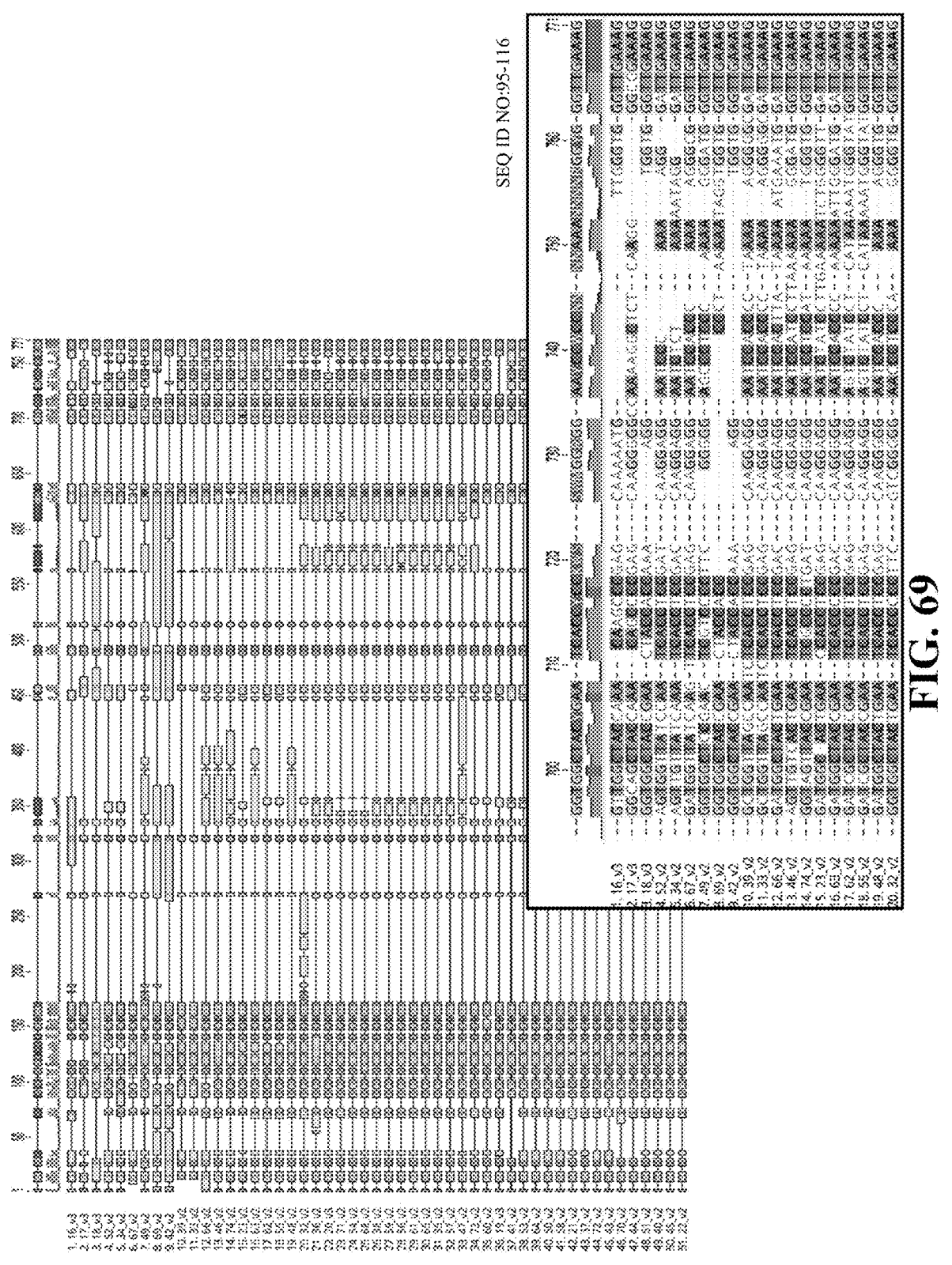

FIG. 69 shows examples of predicted sgRNAs (SEQ ID NO:95-116).

Figure 70:
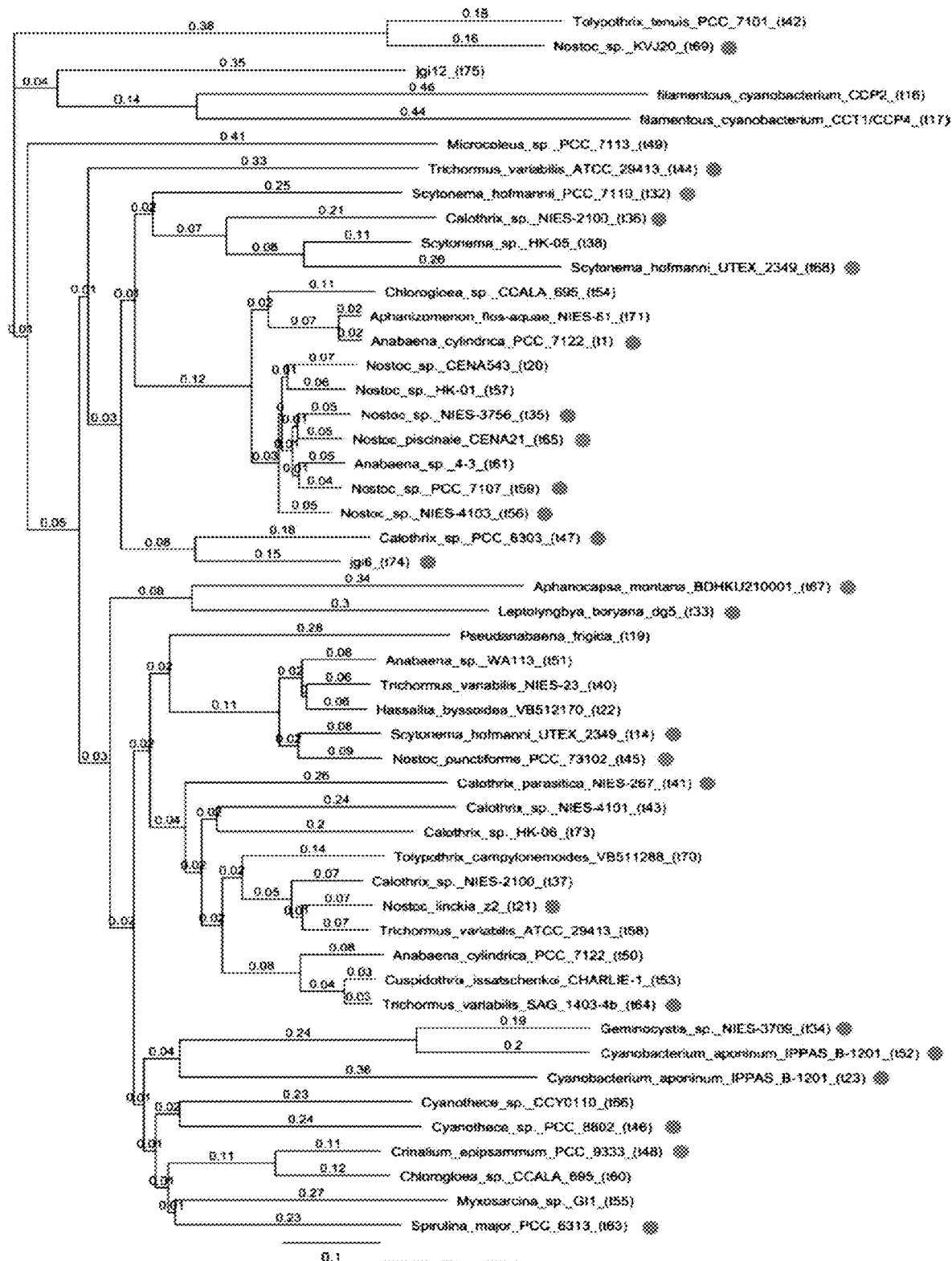

FIG. 70 shows exemplary functional systems identified using various assays.

Figure 71:
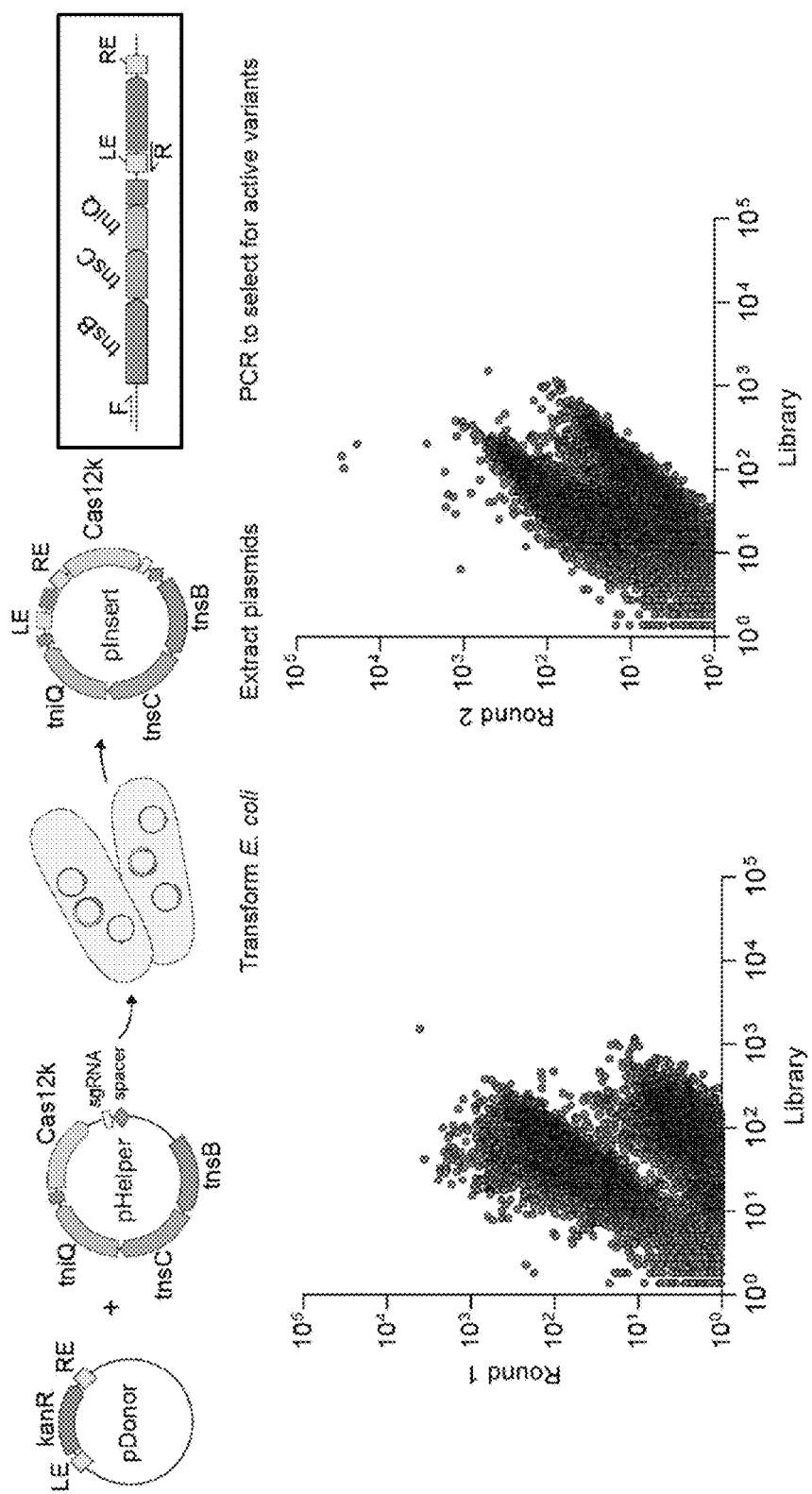

FIG. 71 an exemplary method for screening systems for hyperactive variants and the screening results.

Figure 72:
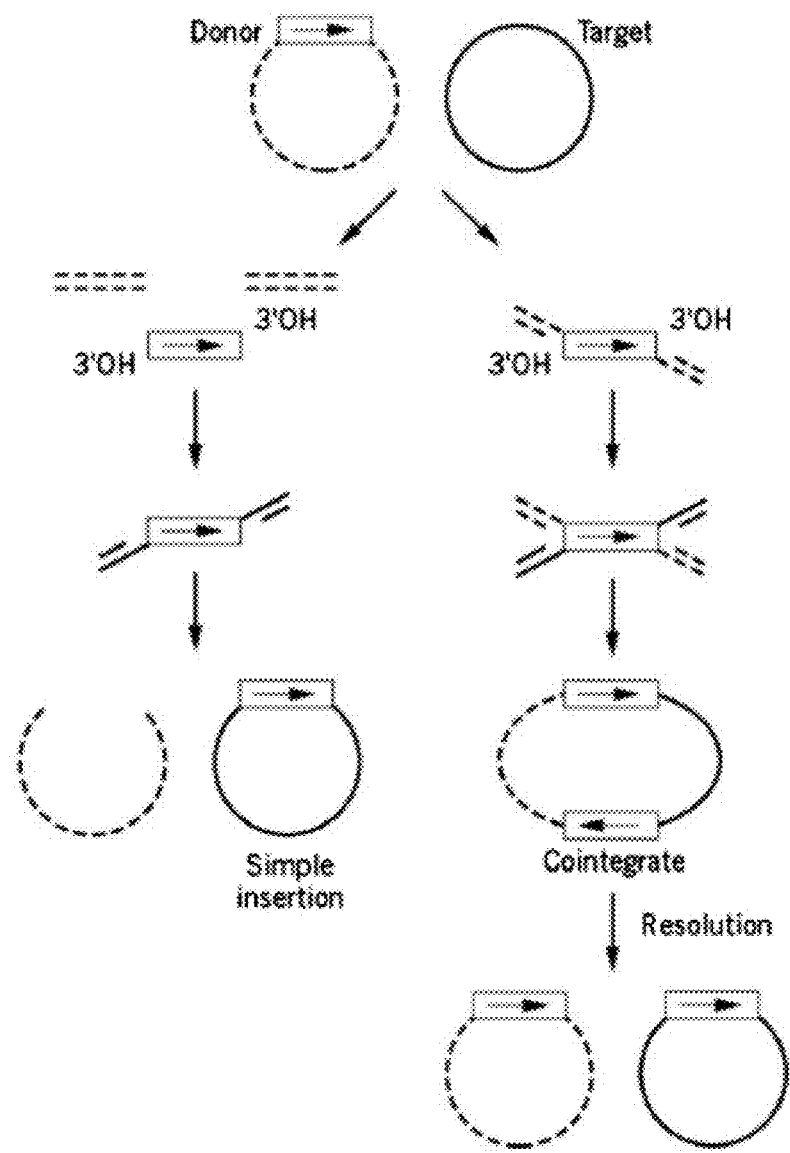

FIG. 72 shows an exemplary method for evaluating insertion products.

Figure 73:
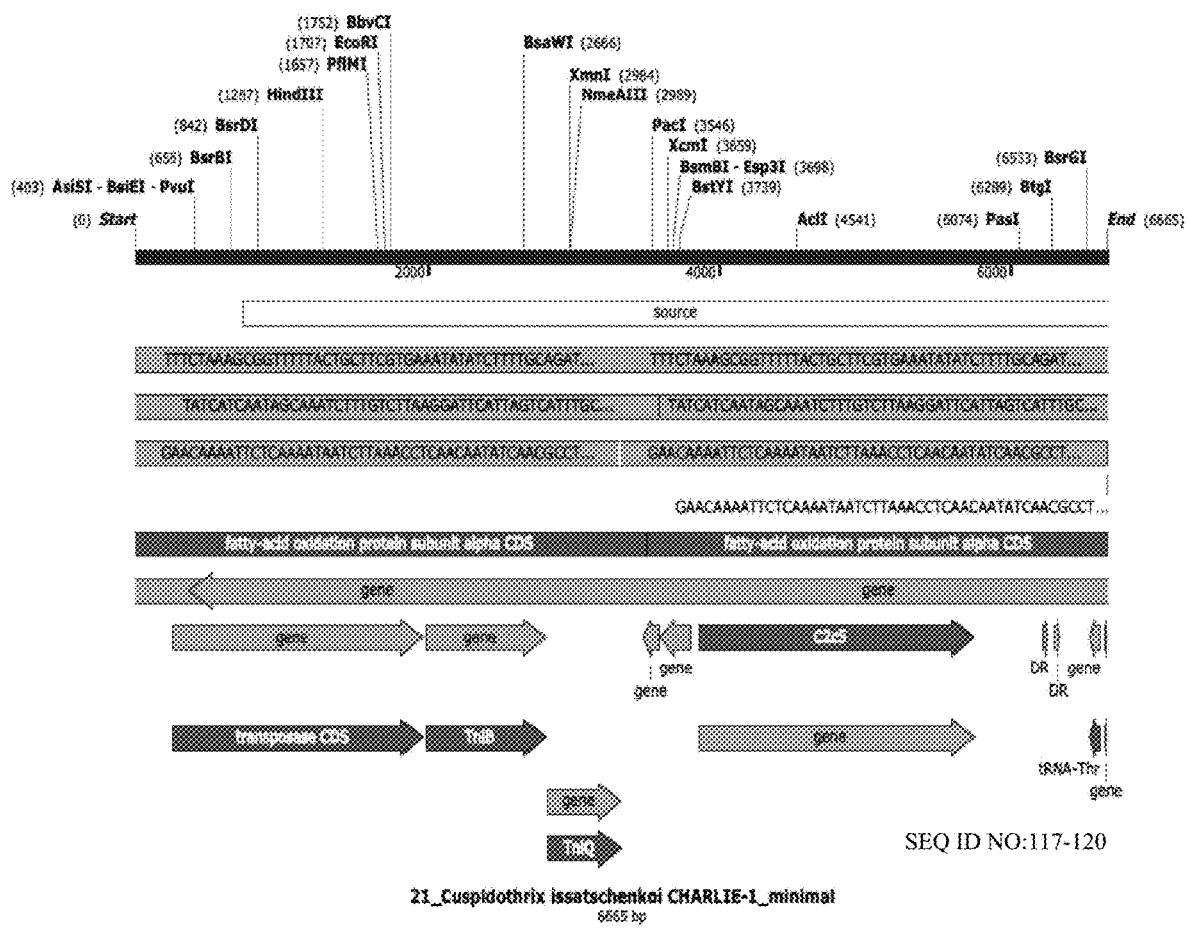

FIG. 73 shows the annotations of an exemplary CAST (System ID T21, *Cuspidothrix issatschenkoi* CHARLIE-1) (SEQ ID NO:117-120).

Figure 74A:
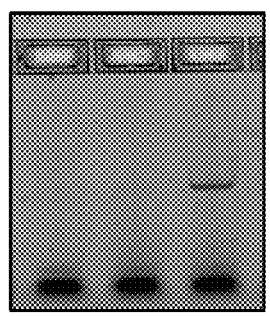
Figure 74B:
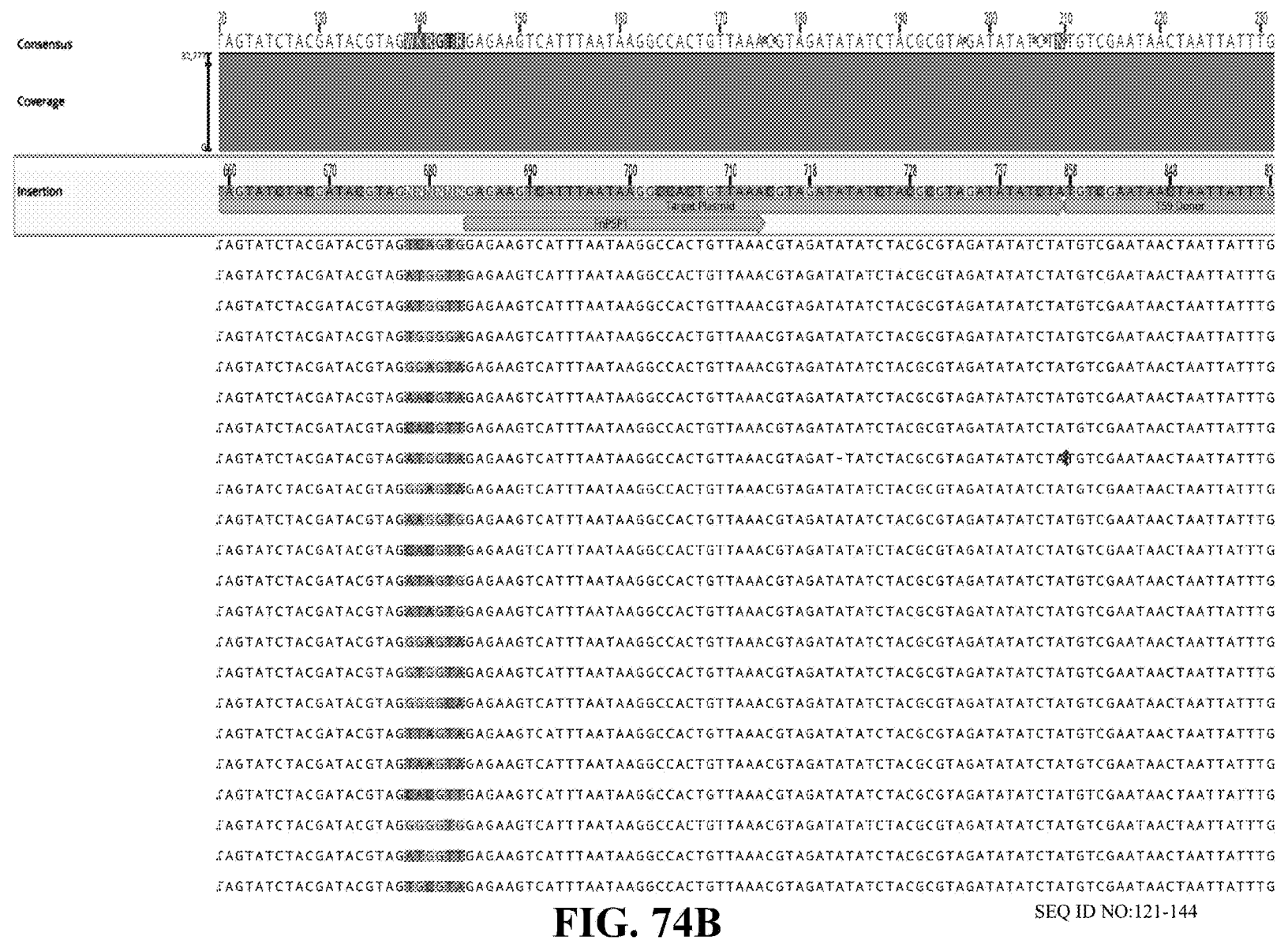

FIGS. 74A-74B. FIG. 74A: T59 NLS-B, C, NLS-Q, and NLS-K or NLS-B, C, NLS-GFP-Q, and NLS-GFP-K were co-transfected into HEK-293 cells. Two days later, the cells were harvested, and the lysate from these cells was added to an in vitro transposition assay with or without sgRNA targeting FnPSP1. The gel shows the result of PCR detection of insertion products from this assay. FIG. 74B: PCR bands from the above reaction were sequenced using NGS, demonstrating verified insertions with an RGTR PAM, approximately 60 bp downstream of the PAM region (SEQ ID NO:121-144).

Figure 75:
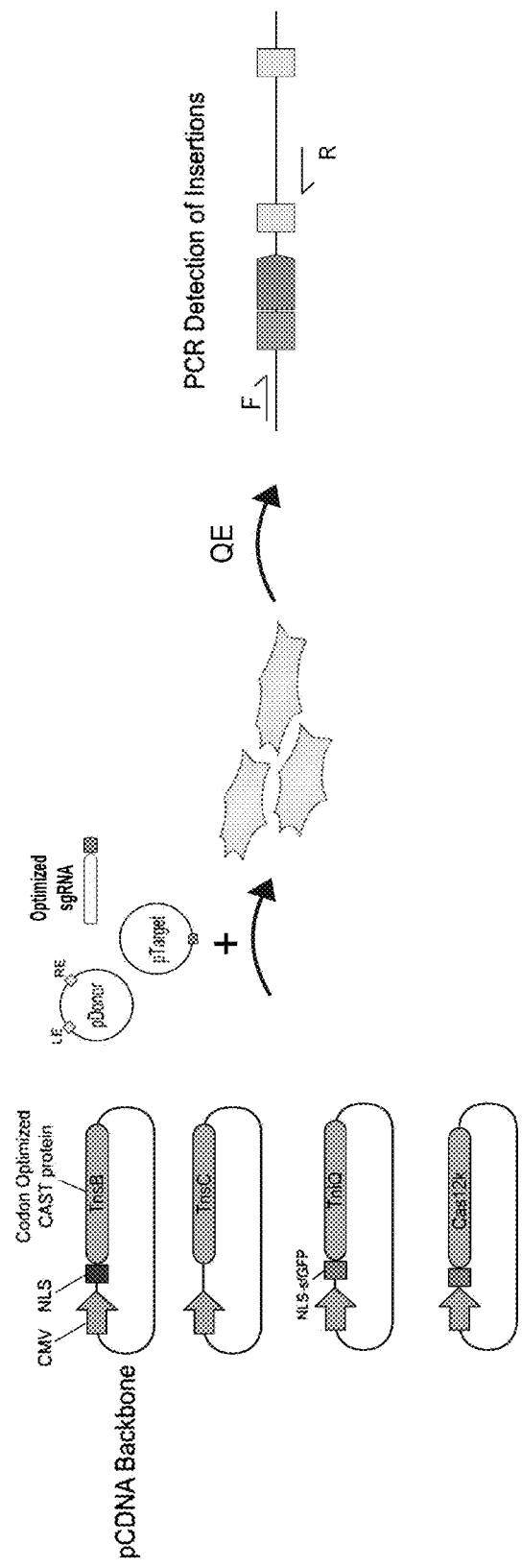

FIG. 75 shows a schematic of plasmid targeting assay in mammalian cells.

Figure 76A:
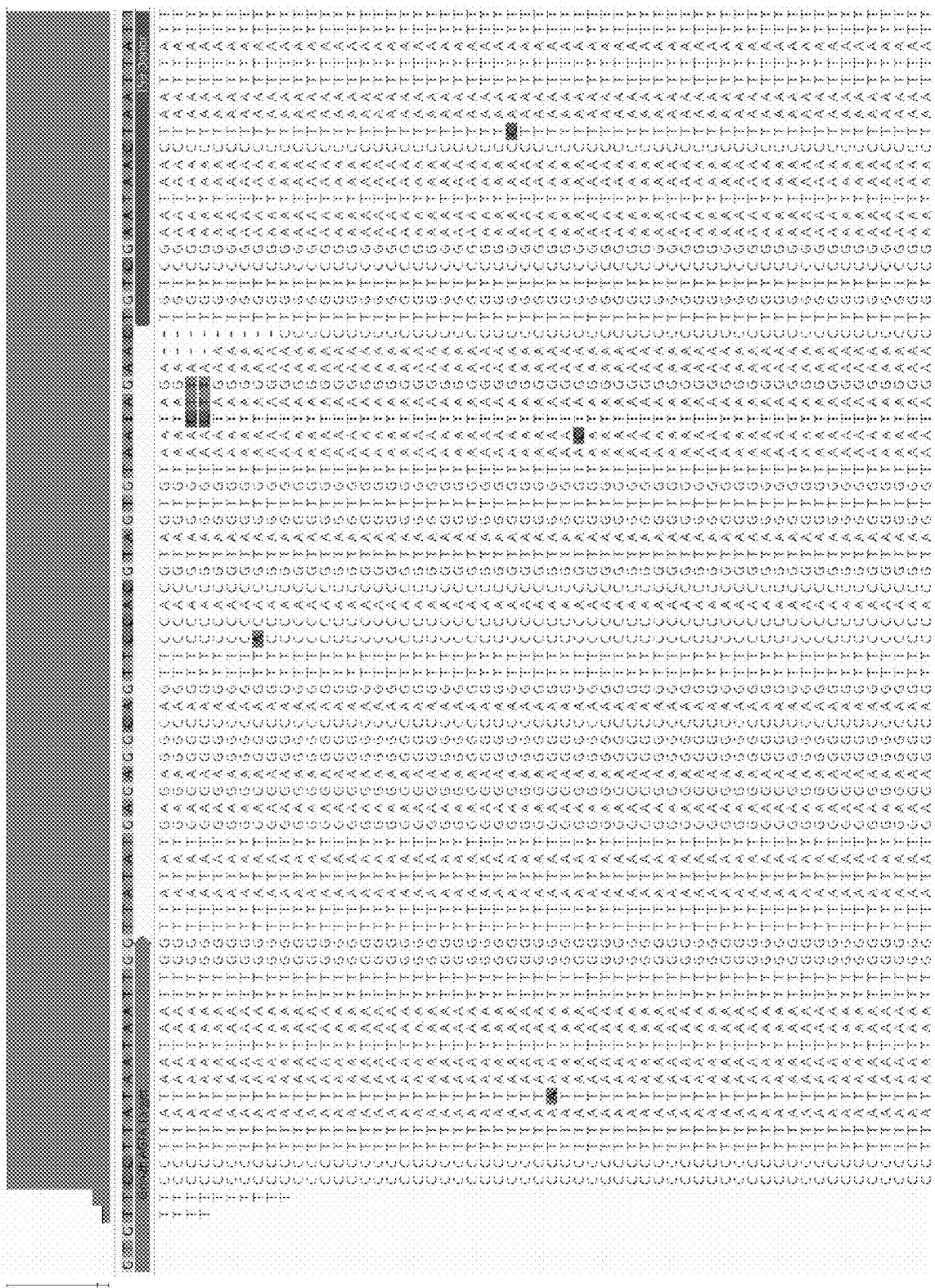

FIG. 76A-76D NGS sequences of verified plamis insertions from plasmid targeting assay in mammalian cells. FIG. 76A Grin2b AGTA target (SEQ ID NO:145-202).

Figure 76B:
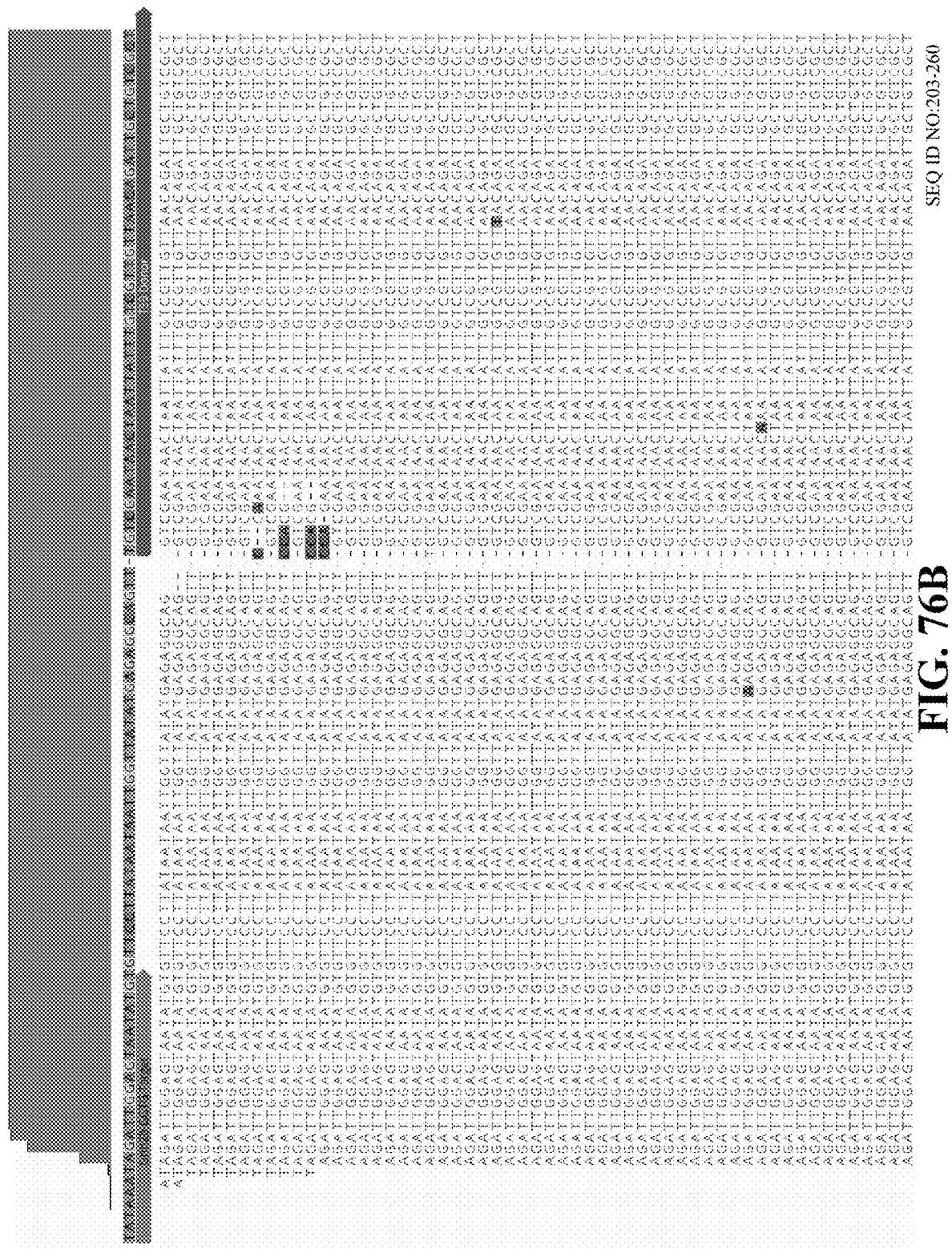
Figure 76C:
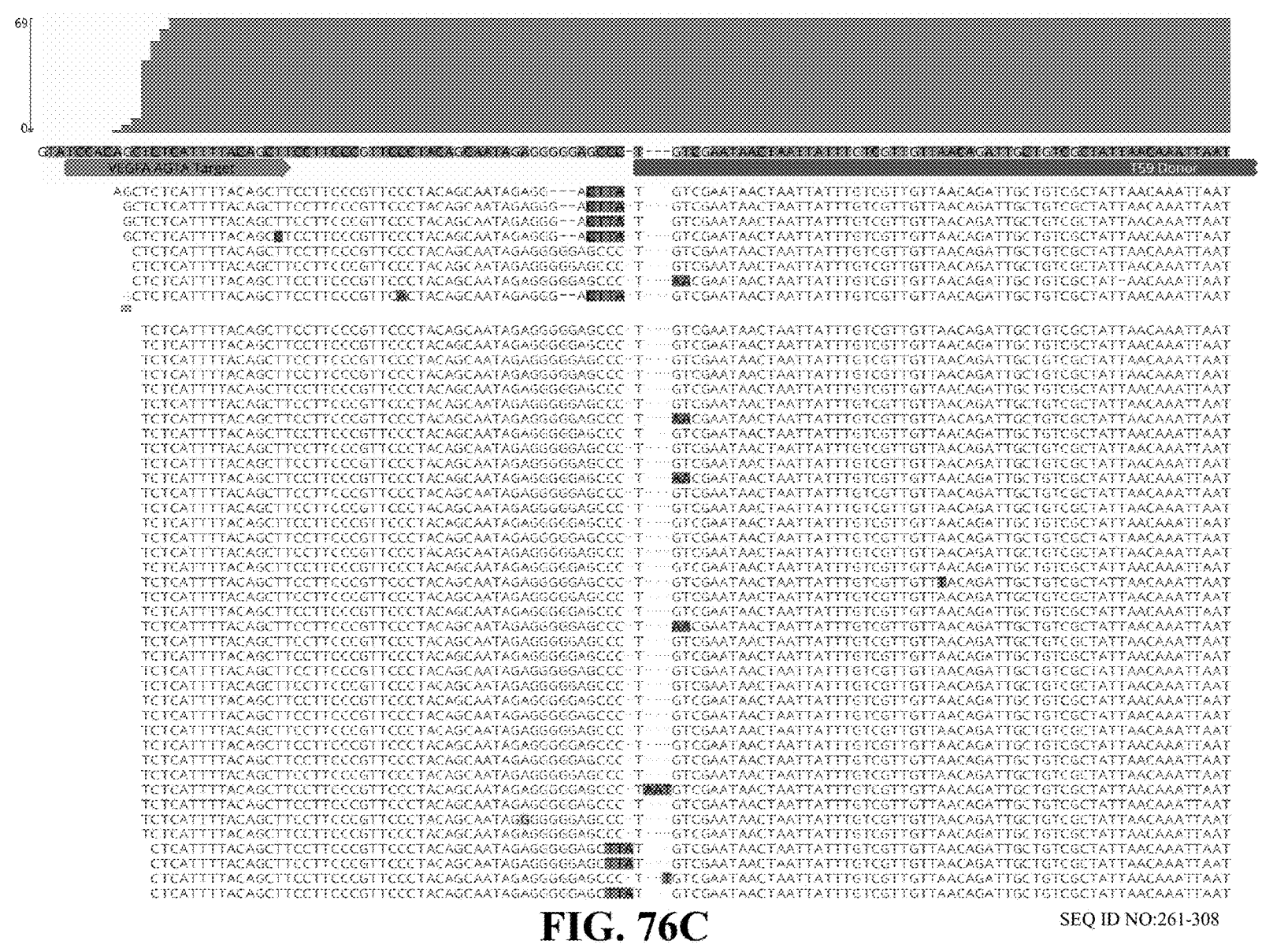
Figure 76D:
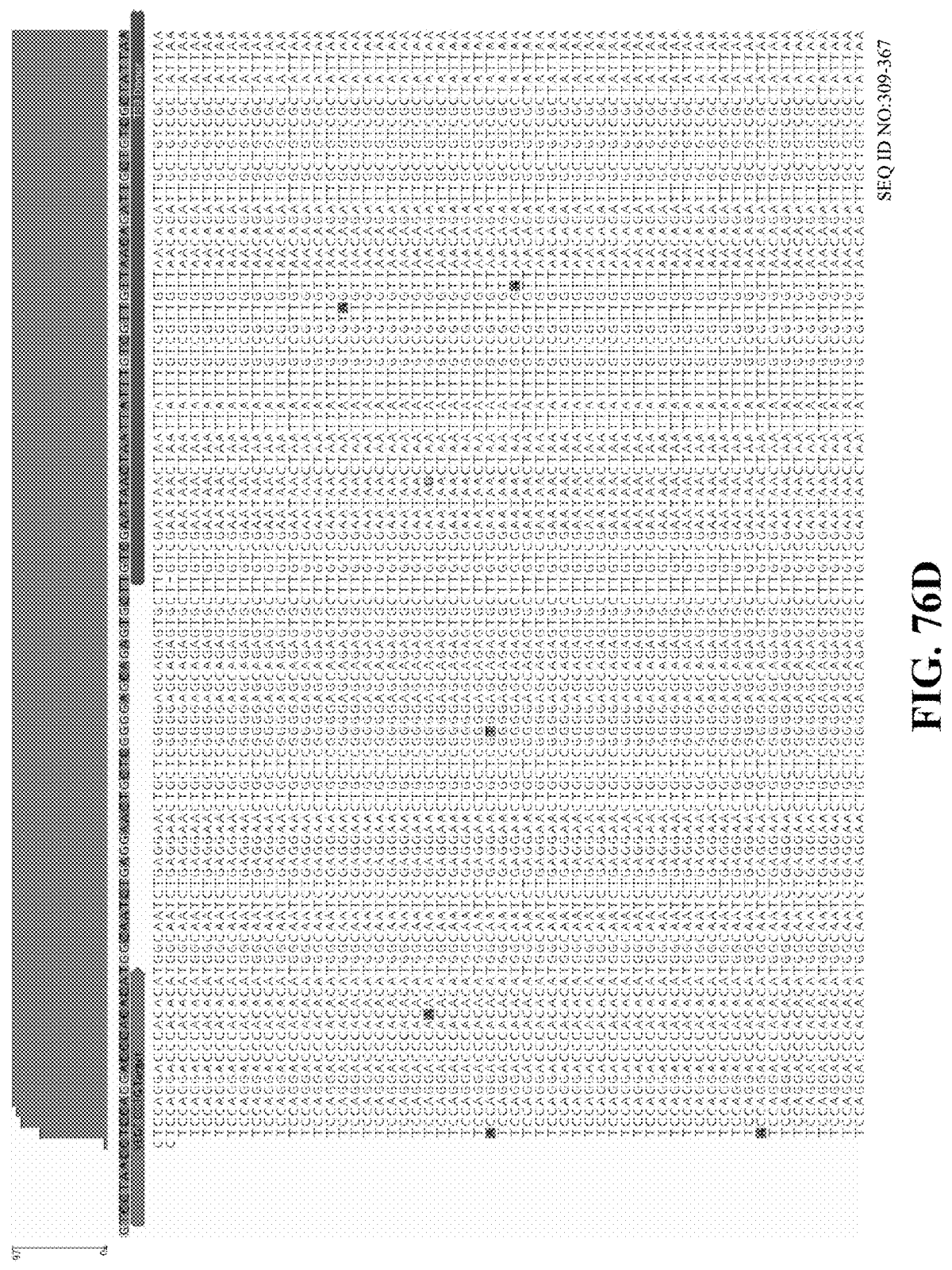

FIG. 76B Grin2b GGTG target (SEQ ID NO:203-260). FIG. 76C VEGFA AGTA target (SEQ ID NO:261-308). FIG. 76D Vegf GGTG target (SEQ ID NO:309-367).

Figure 77:
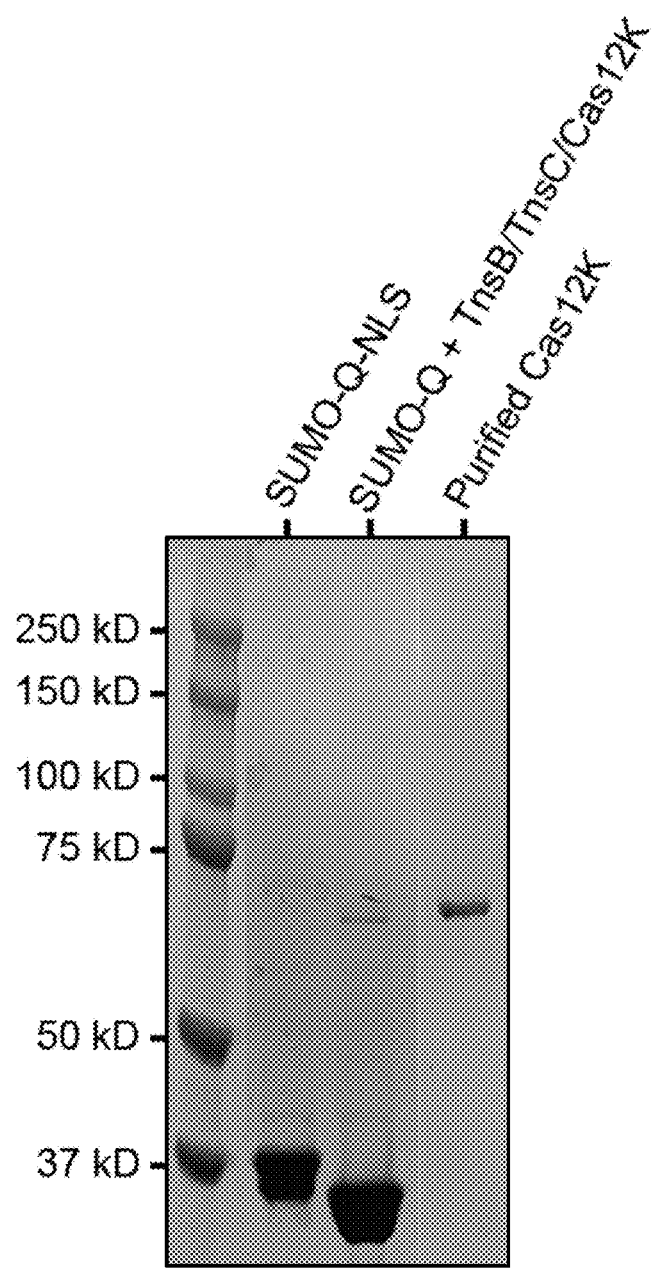

FIG. 77 shows pull-down experiment using SUMO-Q-NLS.

FIGS. 78-81 show maps of T59 Cas12k-T2A constructs V5-V8.

FIGS. 82-85 show maps of T59 Cas12k-Cas9 fusion constructs (SEQ ID NO:368-389).

The figures herein are for illustrative purposes only and are not necessarily drawn to scale.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, 2nd edition (1989) (Sambrook, Fritsch, and Maniatis); Molecular Cloning: A Laboratory Manual, 4th edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, 2nd edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, 2nd edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The term "exemplary" is used herein to mean serving as an example, instance, or illustration. Any aspect or design described herein as "exemplary" is not necessarily to be construed as preferred or advantageous over other aspects or designs. Rather, use of the word exemplary is intended to present concepts in a concrete fashion.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

The recitation of numerical ranges by endpoints includes all numbers and fractions subsumed within the respective ranges, as well as the recited endpoints.

The term "about" or "approximately" as used herein when referring to a measurable value such as a parameter, an amount, a temporal duration, and the like, is meant to encompass variations of +/−20% or less, preferably +/−10% or less, more preferably +1-5% or less, and still more preferably +/−1% or less of and from the specified value, insofar such variations are appropriate to perform in the disclosed invention. It is to be understood that the value to which the modifier "about" or "approximately" refers is itself also specifically, and preferably, disclosed.

Whereas the terms "one or more" or "at least one" or "X or more", where X is a number and understand to mean X or increases one by one of X, such as one or more or at least one member(s) or "X or more" of a group of members, is clear per se, by means of further exemplification, the term encompasses inter alia a reference to any one of said members, or to any two or more of said members, such as, e.g., any >3, >4, >5, >6 or >7 etc. of said members, and up to all said members.

Overview

The present disclosure provides for engineered nucleic acid targeting systems and methods for inserting a polynucleotide to a desired position in a target nucleic acid (e.g., the genome of a cell). In general, the systems comprise one or more transposases or functional fragments thereof, and one or more components of a sequence-specific nucleotide binding system, e.g., a Cas protein and a guide molecule. In some embodiments, the present disclosure provides an engineered nucleic acid targeting system, the system comprising: one or more CRISPR-associated transposase proteins or functional fragments thereof; a Cas protein; and a guide molecule capable of complexing with the Cas protein and directing sequence specific binding of the guide-Cas protein complex to a target sequence of a target polynucleotide. The systems may further comprise one or more donor polynucleotides. The donor polynucleotide may be inserted by the system to a desired position in a target nucleic acid sequence. The present disclosure may further comprise polynucleotides encoding such nucleic acid targeting systems, vector systems comprising one or more vectors comprising said polynucleotides, and one or more cells transformed with said vector systems.

Systems and Compositions

In one aspect, the present disclosure includes systems that comprise one or more transposases and one or more nucleotide-binding molecules (e.g., nucleotide-binding proteins). The nucleotide binding proteins may be sequence-specific. The system may further comprise one or more transposases, transposon components, or functional fragments thereof. In some embodiments, the systems described herein may comprise one or more transposases or transposase sub-units that are associated with, linked to, bound to, or otherwise capable of forming a complex with a sequence-specific nucleotide-binding system. In certain example embodiments, the one or more transposases or transposase sub-units and the sequence-specific nucleotide-binding system are associated by co-regulation or expression. In other example embodiments, the one or more transposases and/or the transposase subunits and sequence-specific nucleotide binding system are associated by the ability of the sequence-specific nucleotide-binding domain to direct or recruit the one or more transposase or transposase subunits to an insertion site where one or more transposases or transpoase subunit direct insertion of a donor polynucleotide into a target polynucleotide sequence. A sequence-specific nucleotide-binding system may be a sequence-specific DNA-binding protein, or functional fragment thereof, and/or sequence-specific RNA-binding protein or functional fragment thereof. In some embodiments, a sequence-specific nucleotide-binding component may be a CRISPR-Cas system, a transcription activator-like effector nuclease, a Zn finger nuclease, a meganuclease, a functional fragment, a variant thereof, or any combination thereof. Accordingly, the system may also be considered to comprise a nucleotide binding component and a transposon component. For ease of reference, further example embodiments will be discussed in the context of example Cas-associated transposase systems.

The nucleotide binding system may comprise a Cas protein, a fragment thereof, or a mutated form thereof. The Cas protein may have reduced or no nuclease activity. For example, the DNA binding domain may be an inactive or dead Cas protein (dCas). The dead Cas protein may comprise one or more mutations or truncations. In some examples, the systems may comprise dCas9 and one or more transposases. In some examples, the DNA binding domain comprises one or more Class 1 (e.g., Type I, Type III, Type VI) or Class 2 (e.g. Type II, Type V, or Type VI) CRISPR-Cas proteins. In certain embodiments, the sequence-specific nucleotide binding domains direct a transposon to a target site comprising a target sequence and the transposase directs insertion of a donor polynucleotide sequence at the target site.

In certain embodiments, the system may comprise more than one Cas protein, one or more of which is mutated and/or in a dead form. In certain cases, one of the Cas proteins or a fragment thereof may serve as a transposase-interacting domain. For example, the system may comprise a Cas protein and a transposase-interacting domain of Cas12k. In a particular example, the system comprises dCas9, Cas12k, and one or more transposases (e.g., Tn7 transposase(s)). In another example, the system comprises dCas9, a transposase-interacting domain of Cas12k, and one or more transposases (e.g., Tn7 transposase(s)).

The systems herein may comprise one or more "CRISPR-associated transposases" (also used interchangeably with Cas-associated transposases, CRISPR-associated transposase proteins, or CAST system herein) or functional fragments thereof. CRISPR-associated transposases may include any transposases or transposase subunity that can be directed to or recruited to a region of a target polynucleotide by sequence-specific binding of a CRISPR-Cas complex to the target polynucleotide. CRISPR-associated transposases may include any transposases that associate (e.g., form a complex) with one or more components in a CRISPR-Cas system, e.g., Cas protein, guide molecule etc.). In certain example embodiments, CRISPR-associated transposases may be fused or tethered (e.g. by a linker) to one or more components in a CRISPR-Cas system, e.g., Cas protein, guide molecule etc.).

A transposase subunit or transposase complex may interact with a Cas protein herein. In some examples, the transposase or transposase complex interacts with the N-terminus of the Cas protein. In certain examples, the transposase or transposase complex interacts with the C-terminus of the Cas protein. In certain examples, the transposase or transposase complex interacts with a fragment of the Cas protein between its N-terminus and C-terminus.

Transposons and Transposases

The systems herein may comprise one or more components of a transposon and/or one or more transposases. The term "transposon", as used herein, refers to a polynucleotide (or nucleic acid segment), which may be recognized by a transposase or an integrase enzyme and which is a component of a functional nucleic acid-protein complex (e.g., a transpososome) capable of transposition. The term "transposase" as used herein refers to an enzyme, which is a component of a functional nucleic acid-protein complex capable of transposition and which mediates transposition. The transposase may comprise a single protein or comprise multiple protein sub-units. A transposase may be an enzyme capable of forming a functional complex with a transposon end or transposon end sequences. The term "transposase" may also refer in certain embodiments to integrases. The expression "transposition reaction" used herein refers to a reaction wherein a transposase inserts a donor polynucleotide sequence in or adjacent to an insertion site on a target polynucleotide. The insertion site may contain a sequence or secondary structure recognized by the transposase and/or an insertion motif sequence where the transposase cuts or creates staggered breaks in the target polynucleotide into which the donor polynucleotide sequence may be inserted. Exemplary components in a transposition reaction include a transposon, comprising the donor polynucleotide sequence to be inserted, and a transposase or an integrase enzyme. The term "transposon end sequence" as used herein refers to the nucleotide sequences at the distal ends of a transposon. The transposon end sequences may be responsible for identifying the donor polynucleotide for transposition. The transposon end sequences may be the DNA sequences the transpose enzyme uses in order to form transpososome complex and to perform a transposition reaction.

Transposons employ a variety of regulatory mechanisms to maintain transposition at a low frequency and sometimes coordinate transposition with various cell processes. Some prokaryotic transposons can also mobilize functions that benefit the host or otherwise help maintain the element. Certain transposons have evolved mechanisms of tight control over target site selection, the most notable example being the Tn7 family (see Peters J E (2014) Tn7. Microbiol Spectr 2:1-20). Three transposon-encoded proteins form the core transposition machinery of Tn7: a heteromeric transposase (TnsA and TnsB) and a regulator protein (TnsC). In addition to the core TnsABC transposition proteins, Tn7 elements encode dedicated target site-selection proteins, TnsD and TnsE. In conjunction with TnsABC, the sequence-specific DNA-binding protein TnsD directs transposition into a conserved site referred to as the "Tn7 attachment site," attTn7. TnsD is a member of a large family of proteins that also includes TniQ, a protein found in other types of bacterial transposons. TniQ has been shown to target transposition into resolution sites of plasmids.

In one example embodiment, the disclosure provides systems comprising a Tn7 transposon system or components thereof. The transposon system may provide functions including but not limited to target recognition, target cleavage, and polynucleotide insertion. In certain example embodiments, the transposon system does not provide target polynucleotide recognition but provides target polynucleotide cleavage and insertion of a donor polynucleotide into the target polynucleotide.

Tn7 or Tn7-Like Transposases

The one or more transposases herein may comprise one or more Tn7 or Tn7 like transposases. In certain example embodiments, the Tn7 or Tn7 like transposase comprises a multi-meric protein complex. In certain example embodiments, the multi-meric protein complex comprises TnsA, TnsB and TnsC. In other example embodiments, the transposase may comprise TnsB, TnsC, and TniQ. In another example embodiment, the Tn7 transposase may comprise TnsB, TnsC, and TnsD. In certain example embodiments, the Tn7 transposase may comprise TnsD, TnsE, or both. As used herein, the terms "TnsAB", "TnsAC", "TnsBC", or "TnsABC" refer to a transponson complex comprising TnsA and TnsB, TnsA and TnsC, TnsB and TnsC, TnsA and TnsB and TnsC, respectively. In these combinations, the transposases (TnsA, TnsB, TnsC) may form complexes or fusion proteins with each other. Similarly, the term TnsABC-TniQ refer to a transposon comprising TnsA, TnsB, TnsC, and TniQ, in a form of complex or fusion protein.

In some examples, the one or more transposases or transposase sub-units are, or are derived from, Tn7-like transposases. In a particular embodiment, the Tn7-like transposase may be a Tn5053 transposase. For example, the Tn5053 transposases include those described in Minakhina S et al., Tn5053 family transposons are res site hunters sensing plasmidal res sites occupied by cognate resolvases. Mol Microbiol. 1999 September; 33(5):1059-68; and FIG. 4 and related texts in Partridge S R et al., Mobile Genetic Elements Associated with Antimicrobial Resistance, Clin Microbiol Rev. 2018 Aug. 1; 31(4), both of which are incorporated by reference herein in their entirety. In some cases, the one or more Tn5053 transposases may comprise one or more of TniA, TniB, and TniQ. TniA is also known as TnsB. TniB is also known as TnsC. TniQ is also known as TnsD. Accordingly, in certain embodiments these Tn5053 transposase subunits may be referred to as TnsB, TnsC, and TnsD, respectively. In certain cases, the one or more transposases may comprise TnsB, TnsC, and TnsD. In one example, a CAST system comprises TniA, TniB, TniQ, Cas12k, tracrRNA, and guide RNA(s). In another example, a CAST system comprises TnsB, TnsC, TnsD, Cas12k, tracrRNA, and guide RNA(s).

In some examples, the one or more CRISPR-associated transposases may comprise: (a) TnsA, TnsB, TnsC, and TniQ, (b) TnsA, TnsB, and TnsC, (c) TnsB and TnsC, (d) TnsB, TnsC, and TniQ, (e) TnsA, TnsB, and TniQ, (f) TnsE, or (g) any combination thereof. In some cases, the TnsE does not bind to DNA. In some cases, CRISPR-associated transposase protein may comprise one or more transposases, e.g., one or more transposase subunits of a Tn7 transposase or Tn7-like transposes, e.g., one or more of TnsA, TnsB, TnsC, and TniQ. In some examples, the one or more transposases comprise TnsB, TnsC, and TniQ.

Example TniQ

Example TniQ proteins that may be used in example embodiments are provided in Table 1 below.

TABLE 1

TniQ proteins and species sources.
TniQ source species and sequence information

| Sequence Deposit | Species |
| --- | --- |
| PSN81037.1 | filamentous cyanobacterium CCP4 |
| PSN15844.1 | filamentous cyanobacterium CCT1 |
| KIF40774.1 | Lyngbya confervoides BDU141951 |
| KIF15850.1 | Aphanocapsa montana BDHKU210001 |
| 1007083209 | Microcoleus PCC 7113 PCC 7113 |
| AFZ13044.1 | Crinalium epipsammum PCC 9333 |
| PSB14771.1 | filamentous cyanobacterium CCP2 |
| ACK66982.1 | Cyanothece sp PCC 8801 |
| 1003731573 | Cyanothece PCC 7822 PCC 7822 |
| 1007036591 | Geitlerinema PCC 7407 PCC 7407 |
| AUB36897.1 | Nostoc flagelliforme CCNUN1 |
| ODH02152.1 | Nostoc sp KVJ20 |
| 1085057686 | Hassallia byssoidea VB512170 |
| BAY96427.1 | Tolypothrix tenuis PCC 7101 |
| BAZ73065.1 | Aulosira laxa NIES 50 |
| BAZ25526.1 | Scytonema sp NIES 4073 |
| 1014176179 | Anabaena wa102 WA102 |
| KIF41179.1 | Lyngbya confervoides BDU141951 |
| KIF16255.1 | Aphanocapsa montana BDHKU210001 |
| PZV06486.1 | Leptolyngbya sp |
| BAY01384.1 | Anabaena cylindrica PCC 7122 |
| AFZ56184.1 | Anabaena cylindrica PCC 7122 |
| WP_051424360.1 | Aphanizomenon flos aquae |
| PSB32846.1 | Chlorogloea sp CCALA 695 |
| BAY38503.1 | Nostoc sp NIES 2111 |
| ALF54858.1 | Nostoc piscinale CENA21 |
| WP_066425687.1.1 | Anabaena sp 4 3 |
| BBD58014 | Nostoc sp HK 01 |
| BAT55395.1 | Nostoc sp NIES 3756 |
| PHM10230.1 | Nostoc sp Peltigera malacea cyanobiont DB3992 |
| WP_088893314.1 | Leptolyngbya ohadii |
| AFZ00422.1 | Calothrix sp PCC 6303 |
| KYC40720.1 | Scytonema hofmanni PCC 7110 |
| ABA20964.1 | Trichormus variabilis ATCC 29413 |
| BAY20689.1 | Calothrix sp NIES 2100 |
| AUT01643.1 | Nostoc sp CENA543 |
| AFY45246.1 | Nostoc spPCC 7107 |
| BAZ48747.1 | Nostoc sp NIES 4103 |
| WP_019497300.1 | Calothrix sp PCC 7103 |
| OKH59026.1 | Scytonema sp HK 05 |
| BAY48803.1 | Scytonema sp HK 05 |
| AFZ19202.1 | Microcoleus sp PCC 7113 |
| ACK66972.1 | Cyanothece sp PCC 8801 |
| BAY29315.1 | Nostoc carneum NIES 2107 |
| OYE02882.1 | Nostoc sp Peltigera membranacea cyanobiont 232 |
| ABA21808.1 | Trichormus variabilis ATCC 29413 |
| 1085030415 | Scytonema millei VB511283 |
| PHK24183.1 | Nostoc linckia z13 |
| PHJ86651.1 | Nostoc linckia z6 |

TABLE 1-continued

TniQ proteins and species sources.
TniQ source species and sequence information

| Sequence Deposit | Species |
| --- | --- |
| PHK11295.1 | Nostoc linckia z9 |
| PHK05019.1 | Nostoc linckia z8 |
| PHJ98765.1 | Nostoc linckia z7 |
| PHJ86579.1 | Nostoc linckia z4 |
| PHJ72144.1 | Nostoc linckia z2 |
| PHJ65860.1 | Nostoc linckia z3 |
| PHK46993.1 | Nostoc linckia z16 |
| PHJ61579.1 | Nostoc linckia z1 |
| PHK35637.1 | Nostoc linckia z18 |
| PHK21752 .1 | Nostoc linckia z14 |
| ABA20776.1 | Trichormus variabilis ATCC 29413 |
| BAY94950.1 | Fremyella diplosiphon NIES 3275 |
| 1030027413 | Tolypothrix PCC 7601 UTEX B 481 |
| BAY94946.1 | Fremyella diplosiphon NIES 3275 |
| BAY21176.1 | Calothrix sp NIES 2100 |
| AFZ58293.1 | Anabaena cylindrica PCC 7122 |
| BAY04727.1 | Anabaena cylindrica PCC 7122 |
| ALB43650.1 | Anabaena sp WA102 |
| PPJ64039.1 | Cuspidothrix issatschenkoi CHARLIE 1 |
| BAZ36950.1 | Calothrix sp NIES 4101 |
| 1007024179 | Rivularia PCC 7116 PCC 7116 |
| BAY83112.1 | Calothrix parasitica NIES 267 |
| PSB32839.1 | Chlorogloea sp CCALA 695 |
| BAQ63846.1 | Geminocystis sp NIES 3709 |
| 1015999696 | Geminocystis NIES 3708 NIES 3708 |
| PHV61492.1 | Cyanobacterium aponinum IPPAS B 1201 |
| AUC60981.1 | Cyanobacterium sp HL 69 |
| AUC60496.1 | Cyanobacterium sp HL 69 |
| ACK66248.1 | Cyanothece sp PCC 8801 |
| ACV01162.1 | Cyanothece sp PCC 8802 |
| EAZ90282.1 | Cyanothece sp CCY0110 |
| BAY57932.1 | Leptolyngbya boryana NIES 2135 |
| BAS62248.1 | Leptolyngbya boryana dg5 |
| BAS55900.1 | Leptolyngbya boryana IAM M 101 |
| PZO41970.1 | Pseudanabaena frigida |
| BAQ60389.1 | Geminocystis sp NIES 3708 tRNA-Val |
| PHV63798.1 | Cyanobacterium aponinum IPPAS B 1201 |
| AFZ43613.1 | Halothece sp PCC 7418 |
| 1002402539 | Cyanothece PCC 7424 PCC 7424 |
| 1033002085 | Gloeocapsa PCC 73106 PCC 73106 |
| WP_036484423.1 | Myxosarcina sp GI1 |
| 1033008262 | Xenococcus PCC 7305 PCC 7305 |
| 1003731291 | Cyanothece PCC 7822 PCC 7822 |
| 1103531115 | Phormidesmis priestleyi Ana |
| 1096456067 | Photobacterium swingsii CAIM 1393 |
| OUC12055.1 | Alkalinema sp CACIAM 70d |
| BAB75327.1 | Nostoc sp PCC 7120 |
| BAY69255.1 | Trichormus variabilis NIES 23 |
| ACC83974.1 | Nostoc punctiforme PCC 73102 |
| WP_029636334.1 | Scytonema hofmanni UTEX B 1581 |
| KIF35556.1 | Hassallia byssoidea VB512170 |
| OBQ23833.1 | Anabaena sp WA113 |
| PSB34853.1 | Chlorogloea sp CCALA 695 |
| AFZ20489.1 | Microcoleus sp PCC 7113 |
| AFZ13441.1 | Crinalium epipsammum PCC 9333 |
| WP_072619870.1 | Spirulina major |

Further example transposase subunit sequences are provided in the "Examples" section below.

Tn5 Transposases

In certain embodiments, the one or more transposases are one or more Tn5 transposases. In some examples, the transposases may comprise TnpA. The transposase may be a Y1 transposase of the IS200/IS605 family, encoded by the insertion sequence (IS) IS608 from *Helicobacter pylori*, e.g., TnpAIS608. Examples of the transposases include those described in Barabas, O., Ronning, D. R., Guynet, C., Hickman, A. B., TonHoang, B., Chandler, M. and Dyda, F. (2008) Mechanism of IS200/IS605 family DNA transposases: activation and transposon-directed target site selection. Cell, 132, 208-220. In certain example embodiments, the transposase is a single stranded DNA transposase. The DNA transposase may be a Cas9 associated transposase. In certain example embodiments, the single stranded DNA transposase is TnpA or a functional fragment thereof. The Cas9 associated transposase systems may comprise a local architecture of Cas9-TnpA, Cas1-Cas2-CRISPR array. The Cas9 may or may not have a tracrRNA associated with it. The Cas9-associated transposase systems may be coded on the same strand or be part of a larger operon. In certain embodiments, the Cas9 may confer target specificity, allowing the TnpA to move a polynucleotide cargo from other target sites in a sequence specific matter. In certain example embodiments, the Cas9-associated transposase are derived from *Flavobacterium granuli* strain DSM-19729, *Salinivirga cyanobacteriivorans* strain L21-Spi-D4, *Flavobactrium aciduliphilum* strain DSM 25663, *Flavobacterium glacii* strain DSM 19728, *Niabella soli* DSM 19437, *Salnivirga cyanobactriivorans* strain L21-Spi-D4, *Alkaliflexus imshenetskii* DSM 150055 strain Z-7010, or *Alkalitala saponilacus*.

In certain embodiments, the transposase is a single-stranded DNA transposase. The single stranded DNA transposase may be TnpA, a functional fragment thereof, or a variant thereof. In certain embodiments, the transposase is a Himar1 transposase, a fragment thereof, or a variant thereof. In one example, the system comprises a dead Cas9 associated with Himar1.

In certain embodiments, the transposases may be one or more *Vibrio cholerae* Tn6677 transposases. In one example, the system may comprise components of variant Type I-F CRISPR-Cas system or polynucleotide(s) encoding thereof. The transposon may include a terminal operon comprising the tnsA, tnsB, and tnsC genes. The transposon may further comprise a tniQ gene. The tniQ gene may be encoded within the cas rather than tns operon. In certain embodiments, the TnsE may be absent in the transposon.

In certain examples, the transposase include one or more of Mu-transposase, TniQ, TniB, or functional domains thereof. In certain examples, the transposase include one or more of TniQ, a TniB, a TnpB, or functional domains thereof. In certain examples, the transposase include one or more of a rve integrase, TniQ, TniB, TnpB domain, or functional domains thereof.

In certain embodiments the system, more particularly the transposase does not include an rve integrase. In certain embodiments the system, more particularly the transposase does not include one or more of Mu-transposase, TniQ, a TniB, a TnpB, a IstB domain or functional domains thereof. In certain embodiments, the system, more particularly the transposase does not include an rye integrase combined with one or more of a TniB, TniQ, TnpB or IstB domain.

In certain embodiments, the system is not a Cas system of CLUST.004377 as described in WO2019/09173, the Cas system of CLUST.009925 as described in WO2019/09175, or the Cas system of CLUST.009467 as described in WO2019/09174.

In certain examples, the transposase include one or more of Mu-transposase, TniQ, TniB, or functional domains thereof. In certain examples, the transposase include one or more of TniQ, a TniB, a TnpB, or functional domains thereof. In certain examples, the transposase include one or more of a rye integrase, TniQ, TniB, TnpB domain, or functional domains thereof.

As used herein, a right end sequence element or a left end sequence element are made in reference to an example Tn7 transposon. The general structure of the left end (LE) and right end (RE) sequence elements of canonical Tn7 is established. Tn7 ends comprise a series of 22-bp TnsB-binding sites. Flanking the most distal TnsB-binding sites is an 8-bp terminal sequence ending with 5'-TGT-3'/3'-ACA-5'. The right end of Tn7 contains four overlapping TnsB-binding sites in the ~90-bp right end element. The left end contains three TnsB-binding sites dispersed in the ~150-bp left end of the element. The number and distribution of TnsB-binding sites can vary among Tn7-like elements. End sequences of Tn7-related elements can be determined by identifying the directly repeated 5-bp target site duplication, the terminal 8-bp sequence, and 22-bp TnsB-binding sites (Peters J E et al., 2017). Example Tn7 elements, including right end sequence element and left end sequence element include those described in Parks A R, Plasmid, 2009 January; 61(1):1-14.

Donor Polynucleotides

The system may further comprise one or more donor polynucleotides (e.g., for insertion into the target polynucleotide). A donor polynucleotide may be an equivalent of a transposable element that can be inserted or integrated to a target site. The donor polynucleotide may be or comprise one or more components of a transposon. A donor polynucleotide may be any type of polynucleotides, including, but not limited to, a gene, a gene fragment, a non-coding polynucleotide, a regulatory polynucleotide, a synthetic polynucleotide, etc. The donor polynucleotide may include a transposon left end (LE) and transposon right end (RE). The LE and RE sequences may be endogenous sequences for the CAST used or may be heterologous sequences recognizable by the CAST used, or the LE or RE may be synthetic sequences that comprise a sequence or structure feature reconized by the CAST and sufficient to allow insertion of the donor polynucleotide into the target polynucleotides. In certain example embodiments, the LE and RE sequences are truncated. In certain example embodiments may be between 100-200 bps, between 100-190 base pairs, 100-180 base pairs, 100-170 base pairs, 100-160 base pairs, 100-150 base pairs, 100-140 base pairs, 100-130 base pairs, 100-120 base pairs, 100-110 base pairs, 20-100 base pairs, 20-90 base pairs, 20-80 base pairs, 20-70 base pairs, 20-60 base pairs, 20-50 base pairs, 20-40 base pairs, 20-30 base pairs, 50 to 100 base pairs, 60-100 base pairs, 70-100 base pairs, 80-100 base pairs, or 90-100 base pairs in length The donor polynucleotide may be inserted at a position upstream or downstream of a PAM on a target polynucleotide. In some embodiments, a donor polynucleotide comprises a PAM sequence. Examples of PAM sequences include TTTN, ATTN, NGTN, RGTR, VGTD, or VGTR.

The donor polynucleotide may be inserted at a position between 10 bases and 200 bases, e.g., between 20 bases and 150 bases, between 30 bases and 100 bases, between 45 bases and 70 bases, between 45 bases and 60 bases, between 55 bases and 70 bases, between 49 bases and 56 bases or between 60 bases and 66 bases, from a PAM sequence on the target polynucleotide. In some cases, the insertion is at a position upstream of the PAM sequence. In some cases, the insertion is at a position downstream of the PAM sequence. In some cases, the insertion is at a position from 49 to 56 bases or base pairs downstream from a PAM sequence. In some cases, the insertion is at a position from 60 to 66 bases or base pairs downstream from a PAM sequence.

The donor polynucleotide may be used for editing the target polynucleotide. In some cases, the donor polynucleotide comprises one or more mutations to be introduced into the target polynucleotide. Examples of such mutations include substitutions, deletions, insertions, or a combination thereof. The mutations may cause a shift in an open reading frame on the target polynucleotide. In some cases, the donor polynucleotide alters a stop codon in the target polynucleotide. For example, the donor polynucleotide may correct a premature stop codon. The correction may be achieved by deleting the stop codon or introduces one or more mutations to the stop codon. In other example embodiments, the donor polynucleotide addresses loss of function mutations, deletions, or translocations that may occur, for example, in certain disease contexts by inserting or restoring a functional copy of a gene, or functional fragment thereof, or a functional regulatory sequence or functional fragment of a regulatory sequence. A functional fragment refers to less than the entire copy of a gene by providing sufficient nucleotide sequence to restore the functionality of a wild type gene or non-coding regulatory sequence (e.g. sequences encoding long non-coding RNA). In certain example embodiments, the systems disclosed herein may be used to replace a single allele of a defective gene or defective fragment thereof. In another example embodiment, the systems disclosed herein may be used to replace both alleles of a defective gene or defective gene fragment. A "defective gene" or "defective gene fragment" is a gene or portion of a gene that when expressed fails to generate a functioning protein or non-coding RNA with functionality of a corresponding wild-type gene. In certain example embodiments, these defective genes may be associated with one or more disease phenotypes. In certain example embodiments, the defective gene or gene fragment is not replaced but the systems described herein are used to insert donor polynucleotides that encode gene or gene fragments that compensate for or override defective gene expression such that cell phenotypes associated with defective gene expression are eliminated or changed to a different or desired cellular phenotype.

In other example embodiments, the systems disclosed herein may be used to augment healthy cells that enhance cell function and/or are therapeutically beneficial. For example, the systems disclosed herein may be used to introduce a chimeric antigen receptor (CAR) into a specific spot of a T cell genome—enabling the T cell to recognize and destroy cancer cells.

In certain embodiments of the invention, the donor may include, but not be limited to, genes or gene fragments, encoding proteins or RNA transcripts to be expressed, regulatory elements, repair templates, and the like. According to the invention, the donor polynucleotides may comprise may comprise left end and right end sequence elements that function with transposition components that mediate insertion.

In certain cases, the donor polynucleotide manipulates a splicing site on the target polynucleotide. In some examples, the donor polynucleotide disrupts a splicing site. The disruption may be achieved by inserting the polynucleotide to a splicing site and/or introducing one or more mutations to the splicing site. In certain examples, the donor polynucleotide may restore a splicing site. For example, the polynucleotide may comprise a splicing site sequence.

The donor polynucleotide to be inserted may have a size from 10 bases to 50 kb in length, e.g., from 50 to 40 kb, from 100 to 30 kb, from 100 bases to 300 bases, from 200 bases to 400 bases, from 300 bases to 500 bases, from 400 bases to 600 bases, from 500 bases to 700 bases, from 600 bases to 800 bases, from 700 bases to 900 bases, from 800 bases to 1000 bases, from 900 bases to from 1100 bases, from 1000 bases to 1200 bases, from 1100 bases to 1300 bases, from 1200 bases to 1400 bases, from 1300 bases to 1500 bases, from 1400 bases to 1600 bases, from 1500 bases to 1700 bases, from 600 bases to 1800 bases, from 1700 bases to 1900 bases, from 1800 bases to 2000 bases, from 1900 bases to 2100 bases, from 2000 bases to 2200 bases, from 2100 bases to 2300 bases, from 2200 bases to 2400 bases, from 2300 bases to 2500 bases, from 2400 bases to 2600 bases, from 2500 bases to 2700 bases, from 2600 bases to 2800 bases, from 2700 bases to 2900 bases, or from 2800 bases to 3000 bases in length.

The components in the systems herein may comprise one or more mutations that alter their (e.g., the transposase(s)) binding affinity to the donor polynucleotide. In some examples, the mutations increase the binding affinity between the transposase(s) and the donor polynucleotide. In certain examples, the mutations decrease the binding affinity between the transposase(s) and the donor polynucleotide. The mutations may alter the activity of the Cas and/or transposase(s).

In certain embodiments, the systems disclosed herein are capable of unidirectional insertion, that is the system inserts the donor polynucleotide in only one orientation. CRISPR-Cas systems The systems herein may comprise one or more components of a CRISPR-Cas system. The one or more components of the CRISPR-Cas system may serve as the nucleotide-binding component in the systems. In certain example embodiments, the transposon component includes, associates with, or forms a complex with a CRISPR-Cas complex. In one example embodiment, the CRISPR-Cas component directs the transposon component and/or transposase(s) to a target insertion site where the transposon component directs insertion of the donor polynucleotide into a target nucleic acid sequence.

The CRISPR-Cas systems herein may comprise a Cas protein (used interchangeably with CRISPR protein, CRISPR enzyme, Cas effector, CRISPR-Cas protein, CRISPR-Cas enzyme) and a guide molecule. Non-limiting examples of Cas proteins include Cas1, Cas1B, Cas2, Cas3, Cas4, Cas5, Cash, Cas7, Cas8, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx16, CsaX, Csx3, Csx1, Csx15, Csf1, Csf2, Csf3, Csf4, Cas9, Cas12 (e.g., Cas12a, Cas12b, Cas12c, Cas12d, Cas12k, etc.), Cas13 (e.g., Cas13a, Cas13b (such as Cas13b-t1, Cas13b-t2, Cas13b-t3), Cas13c, Cas13d, etc.), Cas14, CasX, CasY, or an engineered form of the Cas protein (e.g., an invective, dead form, a nickase form). In some examples, the CRISPR-Cas system is nuclease-deficient.

In some cases, the Cas protein may be orthologues or homologues of the above mentioned Cas proteins. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related.

Examples of Cas proteins that may be used with the systems disclosed herein include Cas proteins of Class 1 and Class 2 CRISPR-Cas systems.

Class I CRISPR-Cas Systems

In certain example embodiments, the CRISPR-Cas system is a Class 1 CRISPR-Cas system, e.g., a Class 1 type I CRISPR-Cas system. In some cases, a Class I CRISPR-Cas system comprises Cascade (a multimeric complex consisting of three to five proteins that processes crRNA arrays), Cas3 (a protein with nuclease, helicase, and exonuclease activity that is responsible for degradation of the target DNA), and crRNA (stabilizes Cascade complex and directs Cascade and Cas3 to DNA target). A Class 1 CRISPR-Cas system may be of a subtype, e.g., Type I-A, Type I-B, Type I-C, Type I-D, Type I-E, Type I-F, Type I-U, Type III-A, Type III-B, Type-III-C, Type-III-D, or Type-IV CRISPR-Cas system.

The Class 1 Type I CRISPR Cas system may be used to catalyze RNA-guided integration of mobile genetic elements into a target nucleic acid (e.g., genomic DNA). For example, the systems herein may comprise a complex between Cascade and a transposon protein (e.g., a Tn7 transposon protein such as TniQ). At a given distance downstream of a target nucleic acid, a donor nucleic acid (e.g., DNA) may be inserted. The insertion may be in one of two possible orientations. The system may be used to integrate a nucleic acid sequence of desired length. In some examples, the Type I CRISPR-Cas system is nuclease-deficient. In some examples, the Type I CRISPR-Cas system is Type I-F CRISPR-Cas system.

A Class 1 Type I-A CRISPR-Cas system may comprise Cas7 (Csa2), Cas8a1 (Csx13), Cas8a2 (Csx9), Cas5, Csa5, Cas6a, Cas3' and/or Cas3. A Type I-B CRISPR-Cas system may comprise Cas6b, Cas8b (Csh1), Cas7 (Csh2) and/or Cas5. A Type I-C CRISPR-Cas system may comprise Cas5d, Cas8c (Csd1), and/or Cas7 (Csd2). A Type I-D CRISPR-Cas system may comprise Cas10d (Csc3), Csc2, Csc1, and/or Cas6d. A Type I-E CRISPR-Cas system may comprise Cse1 (CasA), Cse2 (CasB), Cas7 (CasC), Cas5 (CasD) and/or Cas6e (CasE). A Type I-F CRISPR-Cas system may comprise Cys1, Cys2, Cas7 (Cys3) and/or Cas6f (Csy4). An example Type I-F CRISPR-Cas system may include a DNA-targeting complex Cascade (also known as Csy complex) which is encoded by three genes: cash, cas7, and a natural cas8-cas5 fusion (hereafter referred to simply as cas8). The Type I-F CRISPR-Cas system may further comprise a native CRISPR array, comprising four repeat and three spacer sequences, encodes distinct mature CRISPR RNAs (crRNAs), which we also refer to as guide RNAs. In some examples, the Type I-F CRISPR-Cas system may associate with one or more components of a transposon of *Vibrio Cholerae* Tn6677 described herein.

Examples of Type I CRISPR components include those described in Makarova et al., Annotation and Classification of CRISPR-Cas systems, Methods Mol Biol. 2015; 1311: 47-75.

The associated Class 1 Type I CRISPR system may comprise cas5f, cas6f, cas7f, cas8f, along with a CRISPR array. In some cases, the Type I CRISPR-Cas system comprises one or more of cas5f, cas6f, cas7f, and cas8f. For example, the Type I CRISPR-Cas system comprises cas5f, cas6f, cas7f, and cas8f. In certain cases, the Type I CRISPR-Cas system comprises one or more of cas8f-cas5f, cas6f and cas7f. For example, the Type I CRISPR-Cas system comprises cas8f-cas5f, cas6f and cas7f. As used herein, the term Cas5678f refers to a complex comprising cas5f, cas6f, cas7f, and cas8f.

Class 2 CRISPR-Cas Systems

In certain example embodiments, the CRISPR-Cas system may be a Class 2 CRISPR-Cas system. A Class 2 CRISPR-Cas system may be of a subtype, e.g., Type II-A, Type II-B, Type II-C, Type V-A, Type V-B, Type V-C, Type V-U, Type VI-A, Type VI-B, or Type VI-C CRISPR-Cas system. The definition and exemplary members of the CRISPR-Cas system include those described in Kira S. Makarova and Eugene V. Koonin, Annotation and Classification of CRISPR-Cas systems, Methods Mol Biol. 2015; 1311: 47-75; and Sergey Shmakov et al., Diversity and evolution of class 2 CRISPR-Cas systems, Nat Rev Microbiol. 2017 March; 15(3): 169-182.

Type V CRISPR-Cas Systems

Figure 1:
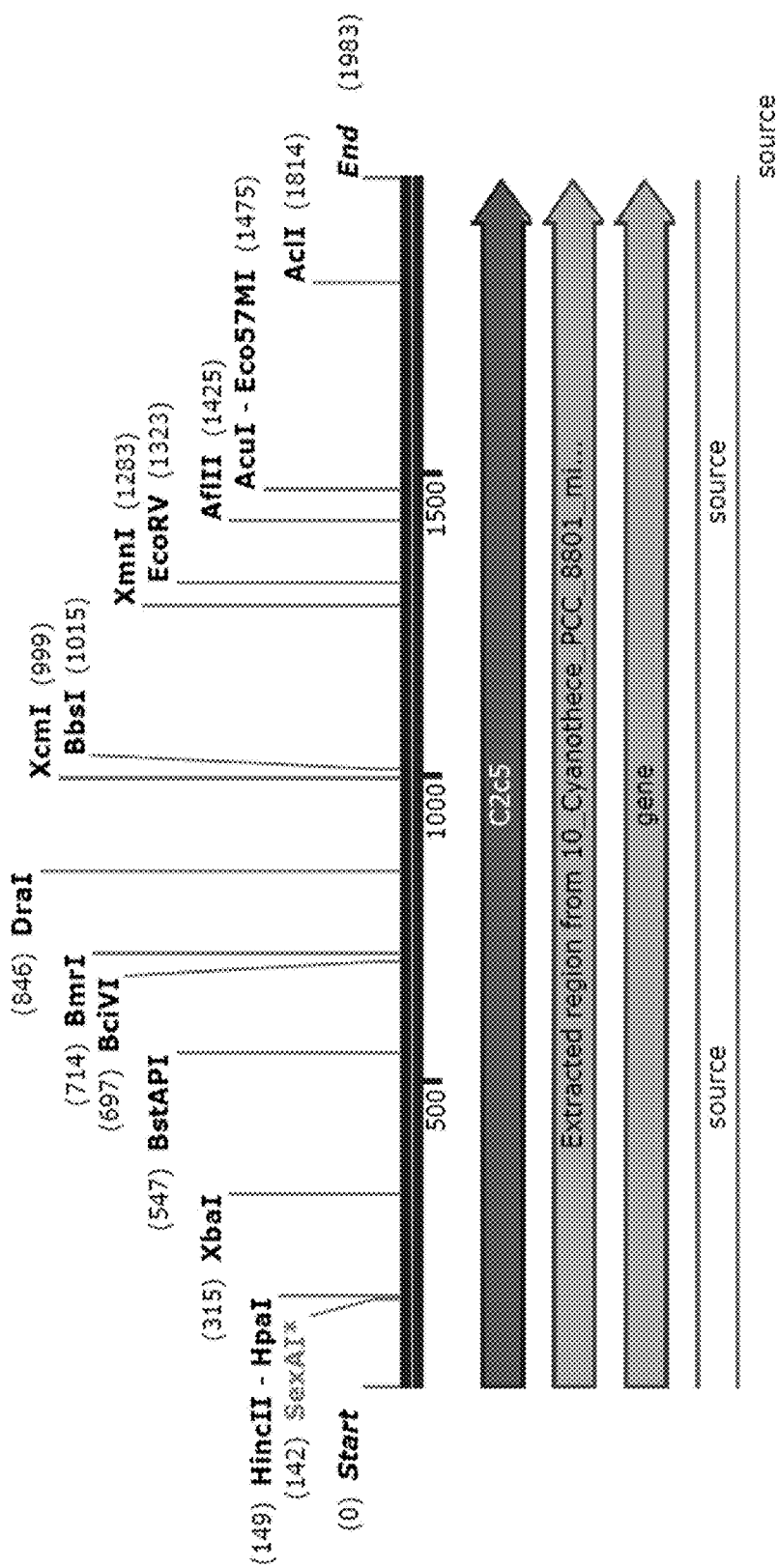
FIG. 1. A map of the V-U5 (c2c5) region of *Cyanothece* sp. PCC 8801 is depicted.
Figure 2A:
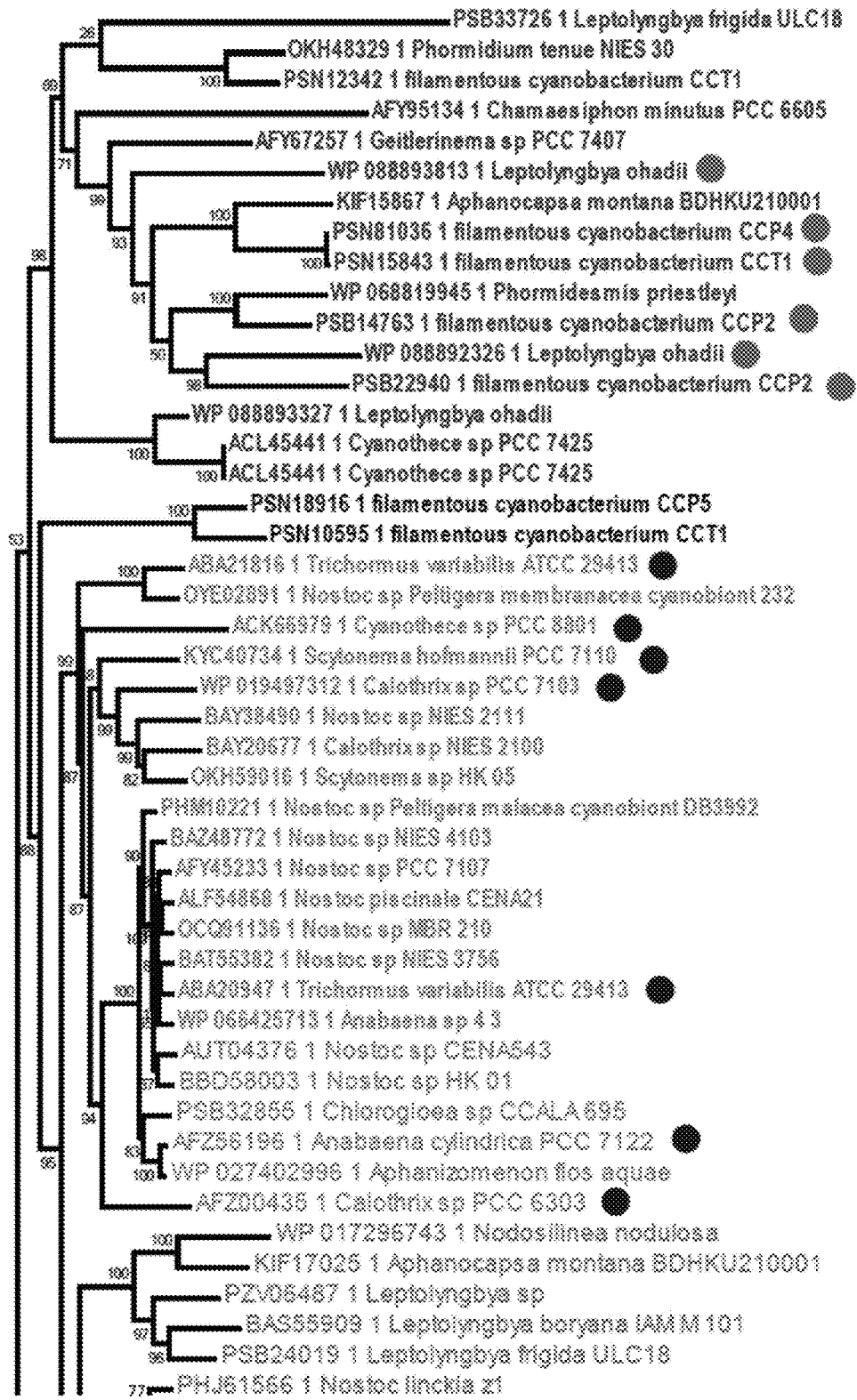
FIGS. 2A-2B. Taxonomy of V-U5 effector proteins.
Figure 2B:
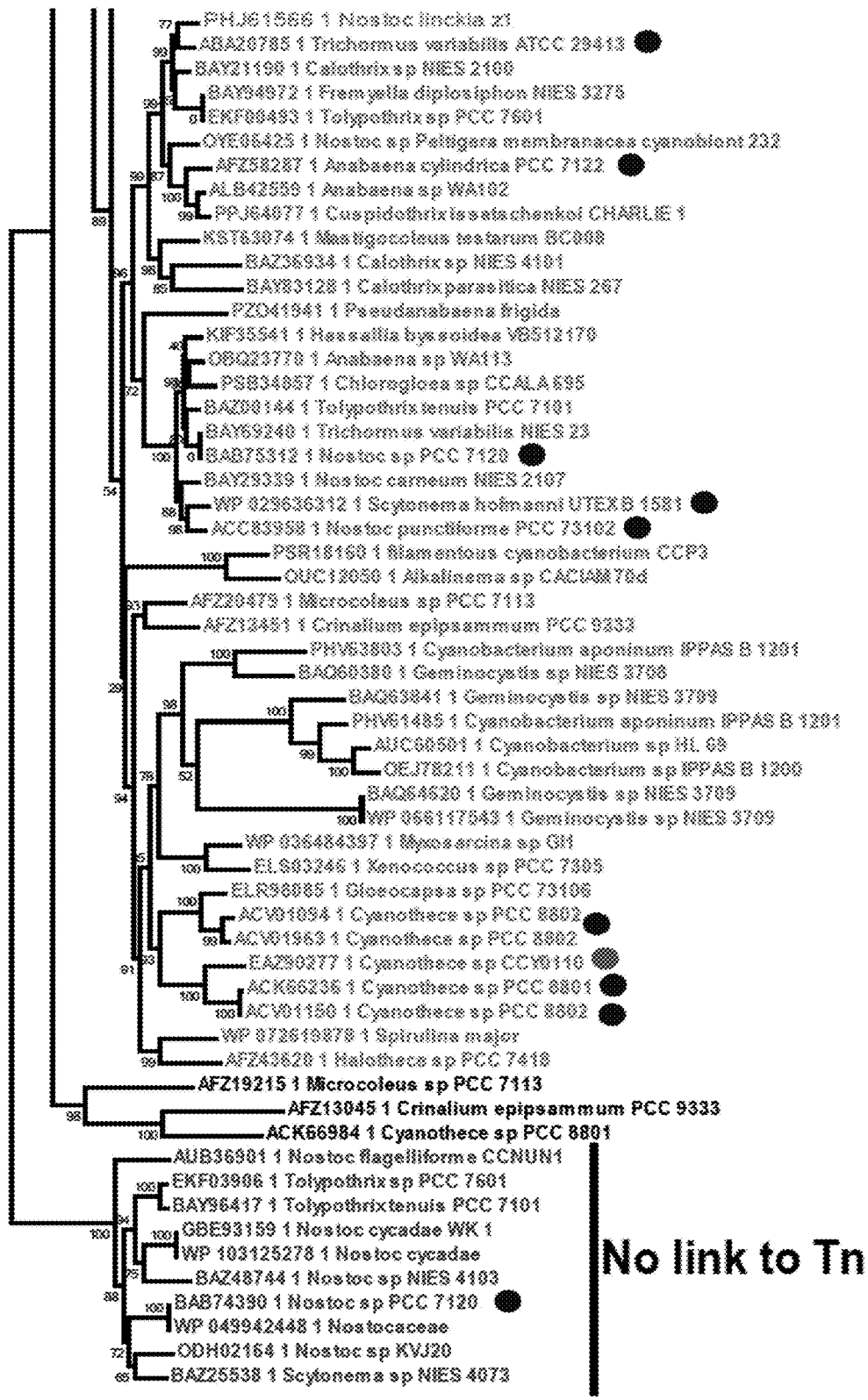

In certain embodiments, the Cas protein may be a Cas protein of a Class 2, Type V CRISPR-Cas system (a Type V Cas protein). The Type V Cas protein may be a Type V-K Cas protein (used interchangeably with Type V-U5, C2c5, and Cas 12k herein). The Cas12k may be of an organism of FIGS. 2A, 2B, and Table 25. The Cas protein may comprise an activation mutation. In one example embodiment, the Cas12k is *Scytonema hofmanni* Cas12k (ShCas12k). For example, the *Scytonema hofmanni* may be *Scytonema hofmanni* (UTEX B 2349). In certain example embodiments, the Cas12k is *Anabaena cylindrica* Cas12k (AcCas12k). For example, the *Anabaena cylindrica* may be *Anabaena cylindrica* (PCC 7122).

Example V-U5/C2c5 Cas proteins that may be used in certain embodiments are provided in Table 2 below

TABLE 2

V-U5/C2c5 proteins
V-U5 source species and sequence information

| Sequence Deposit | Species |
|---|---|
| PSB33726 | *Leptolyngbya frigida* ULC18 |
| OKH48329 | *Phormidium tenue* NIES 30 |
| PSN12342 | filamentous cyanobacterium CCT1 |
| AFY95134 | *Chamaesiphon minutus* PCC 6605 |
| AFY67257 | *Geitlerinema* sp PCC 7407 |
| WP 088893813 | *Leptolyngbya ohadii* |
| KIF15867 | *Aphanocapsa montana* BDHKU210001 |
| PSN81036 | filamentous cyanobacterium CCP4 |
| PSN15843 | filamentous cyanobacterium CCT1 |
| WP 068819945 | *Phormidesmis priestleyi* |
| PSB14763 | filamentous cyanobacterium CCP2 |
| WP 088892326 | *Leptolyngbya ohadii* |
| PSB22940 | filamentous cyanobacterium CCP2 |
| WP 088893327 | *Leptolyngbya ohadii* |
| ACL45441 | *Cyanothece* sp PCC 7425 |
| PSN18916 | filamentous cyanobacterium CCP5 |
| PSN10595 | filamentous cyanobacterium CCT1 |
| ABA21816 | *Trichormus variabilis* ATCC 29413 |
| OYE02891 | *Nostoc* sp *Peltigera membranacea* cyanobiont 232 |
| ACK66979 | *Cyanothece* sp PCC 8801 |
| KYC40734 | *Scytonema hofmanni* PCC 7110 |
| WP 019497312 | *Calothrix* sp PCC 7103 |
| BAY38490 | *Nostoc* sp NIES 2111 |
| BAY20677 | *Calothrix* sp NIES 2100 |
| OKH59016 | *Scytonema* sp HK 05 |
| PHM10221 | *Nostoc* sp *Peltigera malacea* cyanobiont DB3992 |
| BAZ48772 | *Nostoc* sp NIES 4103 |
| AFY45233 | *Nostoc* sp PCC 7107 |
| ALF54868 | *Nostoc piscinale* CENA21 |
| OCQ91136 | *Nostoc* sp MBR 210 |
| BAT55382 | *Nostoc* sp NIES 3756 |
| ABA20947 | *Trichormus variabilis* ATCC 29413 |
| WP 066425713 | *Anabaena* sp 4 3 |
| AUT04376 | *Nostoc* sp CENA543 |
| BBD58003 | *Nostoc* sp HK 01 |
| PSB32855 | *Chlorogloea* sp CCALA 695 |
| AFZ56196 | *Anabaena cylindrica* PCC 7122 |
| WP 027402996 | *Aphanizomenon flos aquae* |
| AFZ00435 | *Calothrix* sp PCC 6303 |
| WP 017296743 | *Nodosilinea nodulosa* |
| KIF17025 | *Aphanocapsa montana* BDHKU210001 |
| PZV06487 | *Leptolyngbya* sp |
| BASS5909 | *Leptolyngbya boryana* IAM M 101 |
| PSB24019 | *Leptolyngbya frigida* ULC18 |
| PHJ61566 | *Nostoc linckia* z1 |
| ABA20785 | *Trichormus variabilis* ATCC 29413 |

TABLE 2-continued

V-U5/C2c5 proteins
V-U5 source species and sequence information

| Sequence Deposit | Species |
|---|---|
| BAY21190 | *Calothrix* sp NIES 2100 |
| BAY94972 | *Fremyella diplosiphon* NIES 3275 |
| EKF00493 | *Tolypothrix* sp PCC 7601 |
| OYE06425 | *Nostoc* sp *Peltigera membranacea* cyanobiont 232 |
| AFZ58287 | *Anabaena cylindrica* PCC 7122 |
| ALB42559 | *Anabaena* sp WA102 |
| PPJ64077 | *Cuspidothrix issatschenkoi* CHARLIE 1 |
| K5T63074 | *Mastigocoleus testarum* BC008 |
| BAZ36934 | *Calothrix* sp NIES 4101 |
| BAY83128 | *Calothrix parasitica* NIES 267 |
| PZ041941 | *Pseudanabaena frigida* |
| KIF35541 | *Hassallia byssoidea* VB512170 |
| OBQ23770 | *Anabaena* sp WA113 |
| P5B34857 | *Chlorogloea* sp CCALA 695 |
| BAZ00144 | *Tolypothrix tenuis* PCC 7101 |
| BAY69240 | *Trichormus variabilis* NIES 23 |
| BAB75312 | *Nostoc* sp PCC 7120 |
| BAY29339 | *Nostoc carneum* NIES 2107 |
| WP_029636312 | *Scytonema hofmannm* UTEX B 1581 |
| ACC83958 | *Nostoc punctiforme* PCC 73102 |
| P5R18160 | filamentous cyanobacterium CCP3 |
| OUC12050 | *Alkalinema* sp CACIAM 70d |
| AFZ20479 | *Microcoleus* sp PCC 7113 |
| AFZ13451 | *Crinalium epipsammum* PCC 9333 |
| PHV63803 | *Cyanobacterium aponinum* IPPAS B 1201 |
| BAQ60380 | *Geminocystis* sp NIES 3708 |
| BAQ63841 | *Geminocystis* sp NIES 3709 |
| PHV61485 | *Cyanobacterium aponinum* IPPAS B 1201 |
| AUC60501 | *Cyanobacterium* sp HL 69 |
| OEJ78211 | *Cyanobacterium* sp IPPAS B 1200 |
| BAQ64620 | *Geminocystis* sp NIES 3709 |
| WP 066117543 | *Geminocystis* sp NIES 3709 |
| WP 036484397 | *Myxosarcina* sp GI1 |
| ELS03246 | *Xenococcus* sp PCC 7305 |
| ELR98085 | *Gloeocapsa* sp PCC 73106 |
| ACV01094 | *Cyanothece* sp PCC 8802 |
| ACV01963 | *Cyanothece* sp PCC 8802 |
| EAZ90277 | *Cyanothece* sp CCY0110 |
| ACK66236 | *Cyanothece* sp PCC 8801 |
| ACV01150 | *Cyanothece* sp PCC 8802 |
| WP 072619878 | *Spirulina major* |
| AFZ43620 | *Halothece* sp PCC 7418 |
| AFZ19215 | *Microcoleus* sp PCC 7113 |
| AFZ13045 | *Crinalium epipsammum* PCC 9333 |
| ACK66984 | *Cyanothece* sp PCC 8801 |
| AUB36901 | *Nostoc flagelliforme* CCNUN1 |
| EKF03906 | *Tolypothrix* sp PCC 7601 |
| BAY96417 | *Tolypothrix tenuis* PCC 7101 |
| GBE93159 | *Nostoc cycadae* WK 1 |
| WP 103125278 | *Nostoc cycadae* |
| BAZ48744 | *Nostoc* sp NIES 4103 |
| BAB74390 | *Nostoc* sp PCC 7120 |
| WP 049942448 | *Nostocaceae* |
| ODH02164 | *Nostoc* sp KVJ20 |
| BAZ25538 | *Scytonema* sp NIES 4073 |

In some embodiments, the CRISPR-Cas system may be one of CLUST.004377 as described in WO2019090173.

The Class 2 Type II Cas protein may be a mutated Cas protein compared to a wildtype counterpart. The mutated Cas protein may be mutated Cas9. The mutated Cas9 may be Cas9$^{D10A}$. Other examples of mutations in Cas9 include H820A, D839A, H840A, N863A, or any combination thereof, e.g., D10A/H820A, D10A, D10A/D839A/H840A, and D10A/D839A/H840A/N863A. The mutations described here are with reference to SpCas9 and also include an analogous mutation in a CRISPR protein other than SpCas9.

Further example Cas sequences are provided in the "Examples" section below"

Dead Cas

In some cases, the Cas protein lacks nuclease activity. Such Cas protein may be a naturally existing Cas protein that does not have nuclease activity or the Cas protein may be an engineered Cas protein with mutations or truncations that reduce or eliminate nuclease activity.

In certain example embodiments, the CRISPR-Cas protein is a Cas9 or Cas9-like protein. In certain example embodiments, the Cas9-like protein is a sub-type V-U protein (where the 'U' stands for 'uncharacterized'), and share two features that distinguish them from type II and type V effectors that are found at CRISPR-cas loci that contain Cas1. First, these proteins are much smaller than class 2 effectors that contain Cas1, comprising between ~500 amino acids (only slightly larger than the typical size of TnpB) and ~700 amino acids (between the size of TnpB and the typical size of the bona fide class 2 effectors). Second, these putative effectors show a higher level of similarity to TnpB proteins than the larger type I and type V effectors. (Shmakov, S. et al., 2017, Nat. Rev. Microbiol., 15:169) One variant (sub-type V-U5), which is found in various cyanobacteria, consists of diverged TnpB homologues that have several mutations in the catalytic motifs of their RuvC-like domain.

In general, a CRISPR-Cas or CRISPR system as used herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). See, e.g., Shmakov et al. (2015) "Discovery and Functional Characterization of Diverse Class 2 CRISPR-Cas systems", Molecular Cell, DOI: dx.doi. org/10.1016/j.molcel.2015.10.008.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM. In certain embodiments, the CRISPR effector protein may recognize a 3' PAM which is 5'H, wherein H is A, C or U.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell.

In certain example embodiments, the CRISPR effector protein may be delivered using a nucleic acid molecule encoding the CRISPR protein. The nucleic acid molecule encoding a CRISPR protein, may advantageously be a codon optimized CRISPR protein. An example of a codon optimized sequence, is in this instance a sequence optimized for expression in eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR protein is a codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g., 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a transgenic cell in which one or more nucleic acids encoding one or more guide RNAs are provided or introduced operably connected in the cell with a regulatory element comprising a promoter of one or more genes of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas transgene can further comprise a Lox-Stop-polyA-Lox(LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter is U6.

Guide Molecules and Tracr Sequences

The system herein may comprise one or more guide molecules. As used herein, the term "guide sequence" and "guide molecule" in the context of a CRISPR-Cas system, comprises any polynucleotide sequence having sufficient complementarity with a target nucleic acid sequence to hybridize with the target nucleic acid sequence and direct sequence-specific binding of a nucleic acid-targeting complex to the target nucleic acid sequence. The guide sequences made using the methods disclosed herein may be a full-length guide sequence, a truncated guide sequence, a full-length sgRNA sequence, a truncated sgRNA sequence, or an E+F sgRNA sequence. In some embodiments, the degree of complementarity of the guide sequence to a given target sequence, when optimally aligned using a suitable alignment algorithm, is about or more than about 50%, 60%, 75%, 80%, 85%, 90%, 95%, 97.5%, 99%, or more. In certain example embodiments, the guide molecule comprises a guide sequence that may be designed to have at least one mismatch with the target sequence, such that a RNA duplex is formed between the guide sequence and the target sequence. Accordingly, the degree of complementarity is preferably less than 99%. For instance, where the guide sequence consists of 24 nucleotides, the degree of complementarity is more particularly about 96% or less. In particular embodiments, the guide sequence is designed to have a stretch of two or more adjacent mismatching nucleotides, such that the degree of complementarity over the entire guide sequence is further reduced. For instance, where the guide sequence consists of 24 nucleotides, the degree of complementarity is more particularly about 96% or less, more particularly, about 92% or less, more particularly about 88% or less, more particularly about 84% or less, more particularly about 80% or less, more particularly about 76% or less, more particularly about 72% or less, depending on whether the stretch of two or more mismatching nucleotides encompasses 2, 3, 4, 5, 6 or 7 nucleotides, etc. In some embodiments, aside from the stretch of one or more mismatching nucleotides, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence (or a sequence in the vicinity thereof) may be evaluated in a test tube by providing the target nucleic acid sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art. A guide sequence, and hence a nucleic acid-targeting guide RNA may be selected to target any target nucleic acid sequence.

In certain embodiments, the guide sequence or spacer length of the guide molecules is from 10 to 50 nt. In certain embodiments, the spacer length of the guide RNA is at least 10 nucleotides. In certain embodiments, the spacer length is from 12 to 14 nt, e.g., 12, 13, or 14 nt, 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27 to 30 nt, e.g., 27, 28, 29, or 30 nt, from 30 to 35 nt, e.g., 30, 31, 32, 33, 34, or 35 nt, or 35 nt or longer. In certain example embodiment, the guide sequence is 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 40, 41, 42, 43, 44, 45, 46, 47 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nt.

In some embodiments, the guide sequence is an RNA sequence of between 10 to 50 nt in length, but more particularly of about 20 to 30 nt advantageously about 20 nt, 23 to 25 nt or 24 nt. The guide sequence is selected so as to ensure that it hybridizes to the target sequence. This is described more in detail below. Selection can encompass further steps which increase efficacy and specificity.

In some embodiments, the guide sequence has a canonical length (e.g., about 15-30 nt) and is used to hybridize with the target RNA or DNA. In some embodiments, a guide molecule is longer than the canonical length (e.g., >30 nt) and is used to hybridize with the target RNA or DNA, such that a region of the guide sequence hybridizes with a region of the RNA or DNA strand outside of the Cas-guide target complex. This can be of interest where additional modifications, such as deamination of nucleotides is of interest. In alternative embodiments, it is of interest to maintain the limitation of the canonical guide sequence length.

In certain example embodiments, the CRISPR-Cas systems further comprise a trans-activating CRISPR (tracr) sequence or "tracrRNA." The tracrRNA includes any polynucleotide sequence that has sufficient complementarity with a crRNA sequence to hybridize. In some embodiments, the degree of complementarity between the tracrRNA sequence and crRNA sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, 60, 70, 80, 90, 100, 110, 120, 130, 140, 150, 160, 170, 180, 190, 200, 210, 220, 230 or more nucleotides in length. In certain example embodiments the tracr is 210, 211, 212, 213, 214, 215, 216, 217, 218, 219, or 220 nucleotides in length. In some embodiments, the tracr sequence and crRNA sequence are contained within a single transcript, such that hybridization between the two produces a transcript having a secondary structure, such as a hairpin. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In a hairpin structure the portion of the sequence 5' of the final "N" and upstream of the loop corresponds to the tracr mate sequence, and the portion of the sequence 3' of the loop corresponds to the tracr sequence. In certain example embodiments, guide molecule and tracr sequence are physically or chemically linked. Example tracrRNA sequences for use in certain embodiments of the invention are described in further detail in the "Examples" section below.

In some embodiments, the sequence of the guide molecule (direct repeat and/or spacer) is selected to reduce the degree of secondary structure within the guide molecule. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In some embodiments, a nucleic acid-targeting guide is designed or selected to modulate intermolecular interactions among guide molecules, such as among stem-loop regions of different guide molecules. It will be appreciated that nucleotides within a guide that base-pair to form a stem-loop are also capable of base-pairing to form an intermolecular duplex with a second guide and that such an intermolecular duplex would not have a secondary structure compatible with CRISPR complex formation. Accordingly, it is useful to select or design DR sequences in order to modulate stem-loop formation and CRISPR complex formation. In some embodiments, about or less than about 75%, 50%, 40%, 30%, 25%, 20%, 15%, 10%, 5%, 1%, or fewer of nucleic acid-targeting guides are in intermolecular duplexes. It will be appreciated that stem-loop variation will often be within limits imposed by DR-CRISPR effector interactions. One way to modulate stem-loop formation or change the equilibrium between stem-loop and intermolecular duplex is to vary nucleotide pairs in the stem of the stem-loop of a DR. For example, in one embodiment, a G-C pair is replaced by an A-U or U-A pair. In another embodiment, an A-U pair is substituted for a G-C or a C-G pair. In another embodiment, a naturally occurring nucleotide is replaced by a nucleotide analog. Another way to modulate stem-loop formation or change the equilibrium between stem-loop and intermolecular duplex is to modify the loop of the stem-loop of a DR. Without being bound by theory, the loop can be viewed as an intervening sequence flanked by two sequences that are complementary to each other. When that intervening sequence is not self-complementary, its effect will be to destabilize intermolecular duplex formation. The same principle applies when guides are multiplexed: while the targeting sequences may differ, it may be advantageous to modify the stem-loop region in the DRs of the different guides. Moreover, when guides are multiplexed, the relative activities of the different guides can be modulated by balancing the activity of each individual guide. In certain embodiments, the equilibrium between intermolecular stem-loops vs. intermolecular duplexes is determined. The determination may be made by physical or biochemical means and can be in the presence or absence of a CRISPR effector.

In some embodiments, it is of interest to reduce the susceptibility of the guide molecule to RNA cleavage, such as cleavage by a CRISPR system that cleaves RNA. Accordingly, in particular embodiments, the guide molecule is adjusted to avoid cleavage by a CRISPR system or other RNA-cleaving enzymes.

In certain embodiments, the guide molecule comprises non-naturally occurring nucleic acids and/or non-naturally occurring nucleotides and/or nucleotide analogs, and/or chemically modifications. Preferably, these non-naturally occurring nucleic acids and non-naturally occurring nucleotides are located outside the guide sequence. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, or 2'-fluoro analogs. Further examples of modified bases include, but are not limited to, 2-aminopurine, 5-bromo-uridine, pseudouridine, inosine, 7-methylguanosine. Examples of guide RNA chemical modifications include, without limitation, incorporation of 2'-O-methyl (M), 2'-O-methyl 3'phosphorothioate (MS), S-constrained ethyl(cEt), or 2'-O-methyl 3'thioPACE (MSP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33(9):985-9, doi: 10.1038/nbt.3290, published online 29 Jun. 2015 Ragdarm et al., 2015, PNAS, E7110-E7111; Allerson et al., J. Med. Chem. 2005, 48:901-904; Bramsen et al., Front. Genet., 2012, 3:154; Deng et al., PNAS, 2015, 112:11870-11875; Sharma et al., Med Chem Comm., 2014, 5:1454-1471; Hendel et al., Nat. Biotechnol. (2015) 33(9): 985-989; Li et al., Nature Biomedical Engineering, 2017, 1, 0066 DOI:10.1038/s41551-017-0066). In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233:74-83). In certain embodiments, a guide comprises ribonucleotides in a region that binds to a target RNA and one or more deoxyribonucleotides and/or nucleotide analogs in a region that binds to a Type V effector. In an embodiment of the invention, deoxyribonucleotides and/or nucleotide analogs are incorporated in engineered guide structures, such as, without limitation, stem-loop regions, and the seed region. In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl 3' phosphorothioate (MS), S-constrained ethyl(cEt), or 2'-O-methyl 3' thioPACE (MSP). Such modification can enhance genome editing efficiency (see Hendel et al., Nat. Biotechnol. (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine, peptides, nuclear localization sequence (NLS), peptide nucleic acid (PNA), polyethylene glycol (PEG), triethylene glycol, or tetraethyleneglycol (TEG). In certain embodiment, the chemical moiety is conjugated to the guide by a linker, such as an alkyl chain. In certain embodiments, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., *eLife*, 2017, 6:e25312, D01:10.7554).

In some embodiments, 3 nucleotides at each of the 3' and 5' ends are chemically modified. In a specific embodiment, the modifications comprise 2'-O-methyl or phosphorothioate analogs. In a specific embodiment, 12 nucleotides in the tetraloop and 16 nucleotides in the stem-loop region are replaced with 2'-O-methyl analogs. Such chemical modifications improve in vivo editing and stability (see Finn et al., *Cell Reports* (2018), 22: 2227-2235). In some embodiments, more than 60 or 70 nucleotides of the guide are chemically modified. In some embodiments, this modification comprises replacement of nucleotides with 2'-O-methyl or 2'-fluoro nucleotide analogs or phosphorothioate (PS) modification of phosphodiester bonds. In some embodiments, the chemical modification comprises 2'-O-methyl or 2'-fluoro modification of guide nucleotides extending outside of the nuclease protein when the CRISPR complex is formed or PS modification of 20 to 30 or more nucleotides of the 3'-terminus of the guide. In a particular embodiment, the chemical modification further comprises 2'-O-methyl analogs at the 5' end of the guide or 2'-fluoro analogs in the seed and tail regions. Such chemical modifications improve stability to nuclease degradation and maintain or enhance genome-editing activity or efficiency, but modification of all nucleotides may abolish the function of the guide (see Yin et al., *Nat. Biotech.* (2018), 35(12): 1179-1187). Such chemical modifications may be guided by knowledge of the structure of the CRISPR complex, including knowledge of the limited number of nuclease and RNA 2'-OH interactions (see Yin et al., *Nat. Biotech.* (2018), 35(12): 1179-1187). In some embodiments, one or more guide RNA nucleotides may be replaced with DNA nucleotides. In some embodiments, up to 2, 4, 6, 8, 10, or 12 RNA nucleotides of the 5'-end tail/seed guide region are replaced with DNA nucleotides. In certain embodiments, the majority of guide RNA nucleotides at the 3' end are replaced with DNA nucleotides. In particular embodiments, 16 guide RNA nucleotides at the 3' end are replaced with DNA nucleotides. In particular embodiments, 8 guide RNA nucleotides of the 5'-end tail/seed region and 16 RNA nucleotides at the 3' end are replaced with DNA nucleotides. In particular embodiments, guide RNA nucleotides that extend outside of the nuclease protein when the CRISPR complex is formed are replaced with DNA nucleotides. Such replacement of multiple RNA nucleotides with DNA nucleotides leads to decreased off-target activity but similar on-target activity compared to an unmodified guide; however, replacement of all RNA nucleotides at the 3' end may abolish the function of the guide (see Yin et al., *Nat. Chem. Biol.* (2018) 14, 311-316). Such modifications may be guided by knowledge of the structure of the CRISPR complex, including knowledge of the limited number of nuclease and RNA 2'-OH interactions (see Yin et al., *Nat. Chem. Biol.* (2018) 14, 311-316).

In some embodiments, the guide molecule forms a stem-loop with a separate non-covalently linked sequence, which can be DNA or RNA. In particular embodiments, the sequences forming the guide are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, these sequences can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thio semicarbazide, thiol, maleimide, haloalkyl, sufonyl, ally, propargyl, diene, alkyne, and azide. Once this sequence is functionalized, a covalent chemical bond or linkage can be formed between this sequence and the direct repeat sequence. Examples of chemical bonds include, but are not limited to, those based on carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, these stem-loop forming sequences can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120: 11820-11821; Scaringe, Methods Enzymol. (2000) 317: 3-18) or 2'-thionocarbamate (2'-TC) chemistry (Dellinger et al., J. Am. Chem. Soc. (2011) 133: 11540-11546; Hendel et al., Nat. Biotechnol. (2015) 33:985-989).

In certain embodiments, the guide molecule comprises (1) a guide sequence capable of hybridizing to a target locus and (2) a tracr mate or direct repeat sequence whereby the direct repeat sequence is located upstream (i.e., 5') or downstream (i.e. 3') from the guide sequence. In a particular embodiment the seed sequence (i.e. the sequence essential for recognition and/or hybridization to the sequence at the target locus) of the guide sequence is approximately within the first 10 nucleotides of the guide sequence.

In a particular embodiment the guide molecule comprises a guide sequence linked to a direct repeat sequence, wherein the direct repeat sequence comprises one or more stem loops or optimized secondary structures. In particular embodiments, the direct repeat has a minimum length of 16 nts and a single stem loop. In further embodiments, the direct repeat has a length longer than 16 nts, preferably more than 17 nts, and has more than one stem loops or optimized secondary structures. In particular embodiments, the guide molecule comprises or consists of the guide sequence linked to all or part of the natural direct repeat sequence. A typical Type V or Type VI CRISPR-cas guide molecule comprises (in 3' to 5' direction or in 5' to 3' direction): a guide sequence, a first complimentary stretch (the "repeat"), a loop (which is typically 4 or 5 nucleotides long), a second complimentary stretch (the "anti-repeat" being complimentary to the repeat), and a poly A (often poly U in RNA) tail (terminator). In certain embodiments, the direct repeat sequence retains its natural architecture and forms a single stem loop. In particular embodiments, certain aspects of the guide architecture can be modified, for example by addition, subtraction, or substitution of features, whereas certain other aspects of guide architecture are maintained. Preferred locations for engineered guide molecule modifications, including but not limited to insertions, deletions, and substitutions include guide termini and regions of the guide molecule that are exposed when complexed with the CRISPR-Cas protein and/or target, for example the stemloop of the direct repeat sequence.

In particular embodiments, the stem comprises at least about 4 bp comprising complementary X and Y sequences, although stems of more, e.g., 5, 6, 7, 8, 9, 10, 11 or 12 or fewer, e.g., 3, 2, base pairs are also contemplated. Thus, for example X2-10 and Y2-10 (wherein X and Y represent any complementary set of nucleotides) may be contemplated. In one aspect, the stem made of the X and Y nucleotides, together with the loop will form a complete hairpin in the overall secondary structure; and, this may be advantageous and the amount of base pairs can be any amount that forms a complete hairpin. In one aspect, any complementary X:Y basepairing sequence (e.g., as to length) is tolerated, so long as the secondary structure of the entire guide molecule is preserved. In one aspect, the loop that connects the stem made of X:Y basepairs can be any sequence of the same length (e.g., 4 or 5 nucleotides) or longer that does not interrupt the overall secondary structure of the guide molecule. In one aspect, the stemloop can further comprise, e.g. an MS2 aptamer. In one aspect, the stem comprises about 5-7 bp comprising complementary X and Y sequences, although stems of more or fewer basepairs are also contemplated. In one aspect, non-Watson Crick basepairing is contemplated, where such pairing otherwise generally preserves the architecture of the stemloop at that position.

In particular embodiments, the natural hairpin or stemloop structure of the guide molecule is extended or replaced by an extended stemloop. It has been demonstrated that extension of the stem can enhance the assembly of the guide molecule with the CRISPR-Cas protein (Chen et al. Cell. (2013); 155(7): 1479-1491). In particular embodiments, the stem of the stemloop is extended by at least 1, 2, 3, 4, 5 or more complementary basepairs (i.e. corresponding to the addition of 2, 4, 6, 8, 10 or more nucleotides in the guide molecule). In particular embodiments these are located at the end of the stem, adjacent to the loop of the stemloop.

In particular embodiments, the susceptibility of the guide molecule to RNases or to decreased expression can be reduced by slight modifications of the sequence of the guide molecule which do not affect its function. For instance, in particular embodiments, premature termination of transcription, such as premature transcription of U6 Pol-III, can be removed by modifying a putative Pol-III terminator (4 consecutive U's) in the guide molecules sequence. Where such sequence modification is required in the stemloop of the guide molecule, it is preferably ensured by a basepair flip.

In a particular embodiment, the direct repeat may be modified to comprise one or more protein-binding RNA aptamers. In a particular embodiment, one or more aptamers may be included such as part of optimized secondary structure. Such aptamers may be capable of binding a bacteriophage coat protein as detailed further herein.

In some embodiments, the guide molecule forms a duplex with a target RNA comprising at least one target cytosine residue to be edited. Upon hybridization of the guide RNA molecule to the target RNA, the cytidine deaminase binds to the single strand RNA in the duplex made accessible by the mismatch in the guide sequence and catalyzes deamination of one or more target cytosine residues comprised within the stretch of mismatching nucleotides.

A guide sequence, and hence a nucleic acid-targeting guide RNA, may be selected to target any target nucleic acid sequence. The target sequence may be mRNA.

In certain embodiments, the target sequence should be associated with a PAM (protospacer adjacent motif) or PFS (protospacer flanking sequence or site); that is, a short sequence recognized by the CRISPR complex. Depending on the nature of the CRISPR-Cas protein, the target sequence should be selected such that its complementary sequence in the DNA duplex (also referred to herein as the non-target sequence) is upstream or downstream of the PAM. In the embodiments of the present invention where the CRISPR-Cas protein is a Cas13 protein, the complementary sequence of the target sequence is downstream or 3' of the PAM or upstream or 5' of the PAM. The precise sequence and length requirements for the PAM differ depending on the Cas13 protein used, but PAMs are typically 2-5 base pair sequences adjacent the protospacer (that is, the target sequence). Examples of the natural PAM sequences for different Cas13 orthologues are provided herein below and the skilled person will be able to identify further PAM sequences for use with a given Cas13 protein.

Further, engineering of the PAM Interacting (PI) domain may allow programing of PAM specificity, improve target site recognition fidelity, and increase the versatility of the CRISPR-Cas protein, for example as described for Cas9 in Kleinstiver B P et al. Engineered CRISPR-Cas9 nucleases with altered PAM specificities. Nature. 2015 Jul. 23; 523 (7561):481-5. doi: 10.1038/nature14592. As further detailed herein, the skilled person will understand that Cas13 proteins may be modified analogously.

In particular embodiments, the guide is an escorted guide. By "escorted" is meant that the CRISPR-Cas system or complex or guide is delivered to a selected time or place within a cell, so that activity of the CRISPR-Cas system or complex or guide is spatially or temporally controlled. For example, the activity and destination of the 3 CRISPR-Cas system or complex or guide may be controlled by an escort RNA aptamer sequence that has binding affinity for an aptamer ligand, such as a cell surface protein or other localized cellular component. Alternatively, the escort aptamer may for example be responsive to an aptamer effector on or in the cell, such as a transient effector, such as an external energy source that is applied to the cell at a particular time.

The escorted CRISPR-Cas systems or complexes have a guide molecule with a functional structure designed to improve guide molecule structure, architecture, stability, genetic expression, or any combination thereof. Such a structure can include an aptamer.

Aptamers are biomolecules that can be designed or selected to bind tightly to other ligands, for example using a technique called systematic evolution of ligands by exponential enrichment (SELEX; Tuerk C, Gold L: "Systematic evolution of ligands by exponential enrichment: RNA ligands to bacteriophage T4 DNA polymerase." Science 1990, 249:505-510). Nucleic acid aptamers can for example be selected from pools of random-sequence oligonucleotides, with high binding affinities and specificities for a wide range of biomedically relevant targets, suggesting a wide range of therapeutic utilities for aptamers (Keefe, Anthony D., Supriya Pai, and Andrew Ellington. "Aptamers as therapeutics." Nature Reviews Drug Discovery 9.7

(2010): 537-550). These characteristics also suggest a wide range of uses for aptamers as drug delivery vehicles (Levy-Nissenbaum, Etgar, et al. "Nanotechnology and aptamers: applications in drug delivery." Trends in Biotechnology 26.8 (2008): 442-449; and, Hicke B J, Stephens A W. "Escort aptamers: a delivery service for diagnosis and therapy." J Clin Invest 2000, 106:923-928.). Aptamers may also be constructed that function as molecular switches, responding to a que by changing properties, such as RNA aptamers that bind fluorophores to mimic the activity of green fluorescent protein (Paige, Jeremy S., Karen Y. Wu, and Samie R. Jaffrey. "RNA mimics of green fluorescent protein." Science 333.6042 (2011): 642-646). It has also been suggested that aptamers may be used as components of targeted siRNA therapeutic delivery systems, for example targeting cell surface proteins (Zhou, Jiehua, and John J. Rossi. "Aptamer-targeted cell-specific RNA interference." Silence 1.1 (2010): 4).

Accordingly, in particular embodiments, the guide molecule is modified, e.g., by one or more aptamer(s) designed to improve guide molecule delivery, including delivery across the cellular membrane, to intracellular compartments, or into the nucleus. Such a structure can include, either in addition to the one or more aptamer(s) or without such one or more aptamer(s), moiety(ies) so as to render the guide molecule deliverable, inducible or responsive to a selected effector. The invention accordingly comprehends a guide molecule that responds to normal or pathological physiological conditions, including without limitation pH, hypoxia, 02 concentration, temperature, protein concentration, enzymatic concentration, lipid structure, light exposure, mechanical disruption (e.g. ultrasound waves), magnetic fields, electric fields, or electromagnetic radiation.

Light responsiveness of an inducible system may be achieved via the activation and binding of cryptochrome-2 and CIB1. Blue light stimulation induces an activating conformational change in cryptochrome-2, resulting in recruitment of its binding partner CIB 1. This binding is fast and reversible, achieving saturation in <15 sec following pulsed stimulation and returning to baseline <15 min after the end of stimulation. These rapid binding kinetics result in a system temporally bound only by the speed of transcription/translation and transcript/protein degradation, rather than uptake and clearance of inducing agents. Cryptochrome-2 activation is also highly sensitive, allowing for the use of low light intensity stimulation and mitigating the risks of phototoxicity. Further, in a context such as the intact mammalian brain, variable light intensity may be used to control the size of a stimulated region, allowing for greater precision than vector delivery alone may offer.

The invention contemplates energy sources such as electromagnetic radiation, sound energy or thermal energy to induce the guide. Advantageously, the electromagnetic radiation is a component of visible light. In a preferred embodiment, the light is a blue light with a wavelength of about 450 to about 495 nm. In an especially preferred embodiment, the wavelength is about 488 nm. In another preferred embodiment, the light stimulation is via pulses. The light power may range from about 0-9 mW/cm2. In a preferred embodiment, a stimulation paradigm of as low as 0.25 sec every 15 sec should result in maximal activation.

The chemical or energy sensitive guide may undergo a conformational change upon induction by the binding of a chemical source or by the energy allowing it act as a guide and have the Cas13 CRISPR-Cas system or complex function. The invention can involve applying the chemical source or energy so as to have the guide function and the Cas13 CRISPR-Cas system or complex function; and optionally further determining that the expression of the genomic locus is altered.

There are several different designs of this chemical inducible system: 1. ABI-PYL based system inducible by Abscisic Acid (ABA) (see, e.g., stke.sciencemag.org/cgi/content/abstract/sigtrans; 4/164/rs2), 2. FKBP-FRB based system inducible by rapamycin (or related chemicals based on rapamycin) (see, e.g., www.nature.com/nmeth/journal/v2/n6/full/nmeth763.html), 3. GID1-GAI based system inducible by Gibberellin (GA) (see, e.g., www.nature.com/nchembio/journal/v8/n5/full/nchembio. 922.html).

A chemical inducible system can be an estrogen receptor (ER) based system inducible by 4-hydroxytamoxifen (4OHT) (see, e.g., www.pnas.org/content/104/3/1027.abstract). A mutated ligand-binding domain of the estrogen receptor called ERT2 translocates into the nucleus of cells upon binding of 4-hydroxytamoxifen. In further embodiments of the invention any naturally occurring or engineered derivative of any nuclear receptor, thyroid hormone receptor, retinoic acid receptor, estrogen receptor, estrogen-related receptor, glucocorticoid receptor, progesterone receptor, androgen receptor may be used in inducible systems analogous to the ER based inducible system.

Another inducible system is based on the design using Transient receptor potential (TRP) ion channel based system inducible by energy, heat or radio-wave (see, e.g., www-.sciencemag.org/content/336/6081/604). These TRP family proteins respond to different stimuli, including light and heat. When this protein is activated by light or heat, the ion channel will open and allow the entering of ions such as calcium into the plasma membrane. This influx of ions will bind to intracellular ion interacting partners linked to a polypeptide including the guide and the other components of the CRISPR-Cas complex or system, and the binding will induce the change of sub-cellular localization of the polypeptide, leading to the entire polypeptide entering the nucleus of cells. Once inside the nucleus, the guide protein and the other components of the CRISPR-Cas complex will be active and modulating target gene expression in cells.

While light activation may be an advantageous embodiment, sometimes it may be disadvantageous especially for in vivo applications in which the light may not penetrate the skin or other organs. In this instance, other methods of energy activation are contemplated, in particular, electric field energy and/or ultrasound which have a similar effect.

Electric field energy is preferably administered substantially as described in the art, using one or more electric pulses of from about 1 Volt/cm to about 10 kVolts/cm under in vivo conditions. Instead of or in addition to the pulses, the electric field may be delivered in a continuous manner. The electric pulse may be applied for between 1 µs and 500 milliseconds, preferably between 1 µs and 100 milliseconds. The electric field may be applied continuously or in a pulsed manner for 5 about minutes.

As used herein, 'electric field energy' is the electrical energy to which a cell is exposed. Preferably the electric field has a strength of from about 1 Volt/cm to about 10 kVolts/cm or more under in vivo conditions (see WO97/49450).

As used herein, the term "electric field" includes one or more pulses at variable capacitance and voltage and including exponential and/or square wave and/or modulated wave and/or modulated square wave forms. References to electric fields and electricity should be taken to include reference to the presence of an electric potential difference in the environment of a cell. Such an environment may be set up by way of static electricity, alternating current (AC), direct current (DC), etc., as known in the art. The electric field may be uniform, non-uniform or otherwise, and may vary in strength and/or direction in a time dependent manner.

Single or multiple applications of electric field, as well as single or multiple applications of ultrasound are also possible, in any order and in any combination. The ultrasound and/or the electric field may be delivered as single or multiple continuous applications, or as pulses (pulsatile delivery).

Electroporation has been used in both in vitro and in vivo procedures to introduce foreign material into living cells. With in vitro applications, a sample of live cells is first mixed with the agent of interest and placed between electrodes such as parallel plates. Then, the electrodes apply an electrical field to the cell/implant mixture. Examples of systems that perform in vitro electroporation include the Electro Cell Manipulator ECM600 product, and the Electro Square Porator T820, both made by the BTX Division of Genetronics, Inc (see U.S. Pat. No. 5,869,326).

The known electroporation techniques (both in vitro and in vivo) function by applying a brief high voltage pulse to electrodes positioned around the treatment region. The electric field generated between the electrodes causes the cell membranes to temporarily become porous, whereupon molecules of the agent of interest enter the cells. In known electroporation applications, this electric field comprises a single square wave pulse on the order of 1000 V/cm, of about 100.mu.s duration. Such a pulse may be generated, for example, in known applications of the Electro Square Porator T820.

Preferably, the electric field has a strength of from about 1 V/cm to about 10 kV/cm under in vitro conditions. Thus, the electric field may have a strength of 1 V/cm, 2 V/cm, 3 V/cm, 4 V/cm, 5 V/cm, 6 V/cm, 7 V/cm, 8 V/cm, 9 V/cm, 10 V/cm, 20 V/cm, 50 V/cm, 100 V/cm, 200 V/cm, 300 V/cm, 400 V/cm, 500 V/cm, 600 V/cm, 700 V/cm, 800 V/cm, 900 V/cm, 1 kV/cm, 2 kV/cm, 5 kV/cm, 10 kV/cm, 20 kV/cm, 50 kV/cm or more. More preferably from about 0.5 kV/cm to about 4.0 kV/cm under in vitro conditions. Preferably the electric field has a strength of from about 1 V/cm to about 10 kV/cm under in vivo conditions. However, the electric field strengths may be lowered where the number of pulses delivered to the target site are increased. Thus, pulsatile delivery of electric fields at lower field strengths is envisaged.

Preferably, the application of the electric field is in the form of multiple pulses such as double pulses of the same strength and capacitance or sequential pulses of varying strength and/or capacitance. As used herein, the term "pulse" includes one or more electric pulses at variable capacitance and voltage and including exponential and/or square wave and/or modulated wave/square wave forms.

Preferably, the electric pulse is delivered as a waveform selected from an exponential wave form, a square wave form, a modulated wave form and a modulated square wave form.

A preferred embodiment employs direct current at low voltage. Thus, Applicants disclose the use of an electric field which is applied to the cell, tissue or tissue mass at a field strength of between 1V/cm and 20V/cm, for a period of 100 milliseconds or more, preferably 15 minutes or more.

Ultrasound is advantageously administered at a power level of from about 0.05 W/cm2 to about 100 W/cm2. Diagnostic or therapeutic ultrasound may be used, or combinations thereof.

As used herein, the term "ultrasound" refers to a form of energy which consists of mechanical vibrations the frequencies of which are so high they are above the range of human hearing. Lower frequency limit of the ultrasonic spectrum may generally be taken as about 20 kHz. Most diagnostic applications of ultrasound employ frequencies in the range 1 and 15 MHz' (From Ultrasonics in Clinical Diagnosis, P. N. T. Wells, ed., 2nd. Edition, Publ. Churchill Livingstone [Edinburgh, London & NY, 1977]).

Ultrasound has been used in both diagnostic and therapeutic applications. When used as a diagnostic tool ("diagnostic ultrasound"), ultrasound is typically used in an energy density range of up to about 100 mW/cm2 (FDA recommendation), although energy densities of up to 750 mW/cm2 have been used. In physiotherapy, ultrasound is typically used as an energy source in a range up to about 3 to 4 W/cm2 (WHO recommendation). In other therapeutic applications, higher intensities of ultrasound may be employed, for example, high intensity focused ultrasound (HIFU) at 100 W/cm up to 1 kW/cm2 (or even higher) for short periods of time. The term "ultrasound" as used in this specification is intended to encompass diagnostic, therapeutic and focused ultrasound.

Focused ultrasound (FUS) allows thermal energy to be delivered without an invasive probe (see Morocz et al 1998 Journal of Magnetic Resonance Imaging Vol. 8, No. 1, pp. 136-142. Another form of focused ultrasound is high intensity focused ultrasound (HIFU) which is reviewed by Moussatov et al in Ultrasonics (1998) Vol. 36, No. 8, pp. 893-900 and TranHuuHue et al in Acustica (1997) Vol. 83, No. 6, pp. 1103-1106.

Preferably, a combination of diagnostic ultrasound and a therapeutic ultrasound is employed. This combination is not intended to be limiting, however, and the skilled reader will appreciate that any variety of combinations of ultrasound may be used. Additionally, the energy density, frequency of ultrasound, and period of exposure may be varied.

Preferably the exposure to an ultrasound energy source is at a power density of from about 0.05 to about 100 Wcm-2. Even more preferably, the exposure to an ultrasound energy source is at a power density of from about 1 to about 15 Wcm-2.

Preferably, the exposure to an ultrasound energy source is at a frequency of from about 0.015 to about 10.0 MHz. More preferably the exposure to an ultrasound energy source is at a frequency of from about 0.02 to about 5.0 MHz or about 6.0 MHz. Most preferably, the ultrasound is applied at a frequency of 3 MHz.

Preferably, the exposure is for periods of from about 10 milliseconds to about 60 minutes. Preferably the exposure is for periods of from about 1 second to about 5 minutes. More preferably, the ultrasound is applied for about 2 minutes. Depending on the particular target cell to be disrupted, however, the exposure may be for a longer duration, for example, for 15 minutes.

Advantageously, the target tissue is exposed to an ultrasound energy source at an acoustic power density of from about 0.05 Wcm-2 to about 10 Wcm-2 with a frequency ranging from about 0.015 to about 10 MHz (see WO 98/52609). However, alternatives are also possible, for example, exposure to an ultrasound energy source at an acoustic power density of above 100 Wcm-2, but for reduced periods of time, for example, 1000 Wcm-2 for periods in the millisecond range or less.

Preferably the application of the ultrasound is in the form of multiple pulses; thus, both continuous wave and pulsed wave (pulsatile delivery of ultrasound) may be employed in any combination. For example, continuous wave ultrasound may be applied, followed by pulsed wave ultrasound, or vice versa. This may be repeated any number of times, in any order and combination. The pulsed wave ultrasound may be applied against a background of continuous wave ultrasound, and any number of pulses may be used in any number of groups.

Preferably, the ultrasound may comprise pulsed wave ultrasound. In a highly preferred embodiment, the ultrasound is applied at a power density of 0.7 Wcm-2 or 1.25 Wcm-2 as a continuous wave. Higher power densities may be employed if pulsed wave ultrasound is used.

Use of ultrasound is advantageous as, like light, it may be focused accurately on a target. Moreover, ultrasound is advantageous as it may be focused more deeply into tissues unlike light. It is therefore better suited to whole-tissue penetration (such as, but not limited to, a lobe of the liver) or whole organ (such as but not limited to the entire liver or an entire muscle, such as the heart) therapy. Another important advantage is that ultrasound is a non-invasive stimulus which is used in a wide variety of diagnostic and therapeutic applications. By way of example, ultrasound is well known in medical imaging techniques and, additionally, in orthopedic therapy. Furthermore, instruments suitable for the application of ultrasound to a subject vertebrate are widely available and their use is well known in the art.

In particular embodiments, the guide molecule is modified by a secondary structure to increase the specificity of the CRISPR-Cas system and the secondary structure can protect against exonuclease activity and allow for 5' additions to the guide sequence also referred to herein as a protected guide molecule.

In one aspect, the invention provides for hybridizing a "protector RNA" to a sequence of the guide molecule, wherein the "protector RNA" is an RNA strand complementary to the 3' end of the guide molecule to thereby generate a partially double-stranded guide RNA. In an embodiment of the invention, protecting mismatched bases (i.e. the bases of the guide molecule which do not form part of the guide sequence) with a perfectly complementary protector sequence decreases the likelihood of target RNA binding to the mismatched basepairs at the 3' end. In particular embodiments of the invention, additional sequences comprising an extended length may also be present within the guide molecule such that the guide comprises a protector sequence within the guide molecule. This "protector sequence" ensures that the guide molecule comprises a "protected sequence" in addition to an "exposed sequence" (comprising the part of the guide sequence hybridizing to the target sequence). In particular embodiments, the guide molecule is modified by the presence of the protector guide to comprise a secondary structure such as a hairpin. Advantageously, there are three or four to thirty or more, e.g., about 10 or more, contiguous base pairs having complementarity to the protected sequence, the guide sequence or both. It is advantageous that the protected portion does not impede thermodynamics of the CRISPR-Cas system interacting with its target. By providing such an extension including a partially double stranded guide molecule, the guide molecule is considered protected and results in improved specific binding of the CRISPR-Cas complex, while maintaining specific activity.

In particular embodiments, use is made of a truncated guide (tru-guide), i.e. a guide molecule which comprises a guide sequence which is truncated in length with respect to the canonical guide sequence length. As described by Nowak et al. (Nucleic Acids Res (2016) 44 (20): 9555-9564), such guides may allow catalytically active CRISPR-Cas enzyme to bind its target without cleaving the target RNA. In particular embodiments, a truncated guide is used which allows the binding of the target but retains only nickase activity of the CRISPR-Cas enzyme.

The guide molecule and tracr molecules discussed above may comprise DNA, RNA, DNA/RNA hybrids, nucleic acid analogues such as, but not limited to, peptide nucleic acids (PNA), locked nucleic acids (LNA), unlocked nucleic acids (UNA), or triazole-linked DNA.

Additional CRISPR-Cas Development and Use Considerations

The present invention may be further illustrated and extended based on aspects of CRISPR-Cas development and use as set forth in the following articles and particularly as relates to delivery of a CRISPR protein complex and uses of an RNA guided endonuclease in cells and organisms:

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, FA., Hsu, PD., Lin, CY., Gootenberg, JS., Konermann, S., Trevino, AE., Scott, DA., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, TJ., Marraffini, L A., Bao, G., & Zhang, F. Nat Biotechnol doi:10.1038/nbt.2647 (2013);

Genome engineering using the CRISPR-Cas9 system. Ran, FA., Hsu, PD., Wright, J., Agarwala, V., Scott, DA., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, DA., Mikkelson, T., Heckl, D., Ebert, BL., Root, D E., Doench, JG., Zhang, F. Science December 12. (2013). [Epub ahead of print];

Crystal structure of cas9 in complex with guide RNA and target DNA. Nishimasu, H., Ran, FA., Hsu, PD., Konermann, S., Shehata, SI., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);

Development and Applications of CRISPR-Cas9 for Genome Engineering, Hsu P D, Lander E S, Zhang F., Cell. June 5; 157(6):1262-78 (2014).

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh 00, Barcena C, Hsu P D, Habib N, Gootenberg J S, Nishimasu H, Nureki O, Zhang F., Nature. January 29; 517(7536):583-8 (2015).

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520(7546):186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR/Cas9 cleavage of viral DNA efficiently suppresses hepatitis B virus," Scientific Reports 5:10833. doi: 10.1038/srep10833 (Jun. 2, 2015)

Nishimasu et al., Crystal Structure of *Staphylococcus aureus* Cas9," Cell 162, 1113-1126 (Aug. 27, 2015)

BCL11A enhancer dissection by Cas9-mediated in situ saturating mutagenesis, Canver et al., Nature 527(7577): 192-7 (Nov. 12, 2015) doi: 10.1038/nature15521. Epub 2015 Sep. 16.

Cpf1 Is a Single RNA-Guided Endonuclease of a Class 2 CRISPR-Cas system, Zetsche et al., Cell 163, 759-71 (Sep. 25, 2015).

Discovery and Functional Characterization of Diverse Class 2 CRISPR-Cas systems, Shmakov et al., Molecular Cell, 60(3), 385-397 doi: 10.1016/j.molcel.2015.10.008 Epub Oct. 22, 2015.

Rationally engineered Cas9 nucleases with improved specificity, Slaymaker et al., Science 2016 Jan. 1 351(6268): 84-88 doi: 10.1126/science.aad5227. Epub 2015 Dec. 1. [Epub ahead of print].

Gao et al, "Engineered Cpf1 Enzymes with Altered PAM Specificities," bioRxiv 091611; doi: dx.doi.org/10.1101/091611 (Dec. 4, 2016)

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR-Cas system for the one-step generation of mice carrying mutations in multiple genes which were traditionally generated in multiple steps by sequential recombination in embryonic stem cells and/or time-consuming intercrossing of mice with a single mutation. The CRISPR-Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and gRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of Streptococcus pyogenes Cas9 in complex with sgRNA and its target DNA at 2.5 Å resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from Streptococcus pyogenes loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays.

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Canver et al. (2015) demonstrated a CRISPR-Cas9-based functional investigation of non-coding genomic elements. The authors developed pooled CRISPR-Cas9 guide RNA libraries to perform in situ saturating mutagenesis of the human and mouse BCL11A enhancers which revealed critical features of the enhancers.

Zetsche et al. (2015) reported characterization of Cpf1, a class 2 CRISPR nuclease from *Francisella novicida* U112 having features distinct from Cas9. Cpf1 is a single RNA-guided endonuclease lacking tracrRNA, utilizes a T-rich protospacer-adjacent motif, and cleaves DNA via a staggered DNA double-stranded break.

Shmakov et al. (2015) reported three distinct Class 2 CRISPR-Cas systems. Two system CRISPR enzymes (C2c1 and C2c3) contain RuvC-like endonuclease domains distantly related to Cpf1. Unlike Cpf1, C2c1 depends on both crRNA and tracrRNA for DNA cleavage. The third enzyme (C2c2) contains two predicted HEPN RNase domains and is tracrRNA independent.

Slaymaker et al. (2016) reported the use of structure-guided protein engineering to improve the specificity of *Streptococcus pyogenes* Cas9 (SpCas9). The authors developed "enhanced specificity" SpCas9 (eSpCas9) variants which maintained robust on-target cleavage with reduced off-target effects.

The methods and tools provided herein are exemplified for certain Type V effectors. Further type V nucleases with similar properties can be identified using methods described in the art (Shmakov et al. 2015, 60:385-397; Abudayeh et al. 2016, Science, 5; 353(6299)). In particular embodiments, such methods for identifying novel CRISPR effector proteins may comprise the steps of selecting sequences from the database encoding a seed which identifies the presence of a CRISPR Cas locus, identifying loci located within 10 kb of the seed comprising Open Reading Frames (ORFs) in the selected sequences, selecting therefrom loci comprising ORFs of which only a single ORF encodes a novel CRISPR effector having greater than 700 amino acids and no more than 90% homology to a known CRISPR effector. In particular embodiments, the seed is a protein that is common to the CRISPR-Cas system, such as Cas1. In further embodiments, the CRISPR array is used as a seed to identify new effector proteins.

Preassembled recombinant CRISPR-Type V effector complexes comprising Type V effector and crRNA may be transfected, for example by electroporation, resulting in high mutation rates and absence of detectable off-target mutations, as has been demonstrated for certain other CRISPR effectors. Hur, J. K. et al, Targeted mutagenesis in mice by electroporation of Cpf1 ribonucleoproteins, Nat Biotechnol. 2016 Jun. 6. doi: 10.1038/nbt.3596. [Epub ahead of print]. Genome-wide analyses shows that Cpf1 is highly specific. By one measure, in vitro cleavage sites determined for SpCas9 in human HEK293T cells were significantly fewer than for SpCas9. Kim, D. et al., Genome-wide analysis reveals specificities of Cpf1 endonucleases in human cells, Nat Biotechnol. 2016 Jun. 6. doi: 10.1038/nbt.3609. [Epub ahead of print]. An efficient multiplexed system employing Cpf1 has been demonstrated in *Drosophila* employing gRNAs processed from an array containing inventing tRNAs. Port, F. et al, Expansion of the CRISPR toolbox in an animal with tRNA-flanked Cas9 and Cpf1 gRNAs. doi: dx.doi.org/10.1101/046417.

Also, "Dimeric CRISPR RNA-guided Fold nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided Fold Nucleases that recognize extended sequences and can edit endogenous genes with high efficiencies in human cells.

With respect to general information on CRISPR-Cas systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,697,359, 8,771,945, 8,795,965, 8,865,406, 8,871,445, 8,889,356, 8,889,418, 8,895,308, 8,906,616, 8,932,814, 8,945,839, 8,993,233 and 8,999,641; Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); US 2015-0184139 (U.S. application Ser. No. 14/324,960); 14/054,414 European Patent Applications EP 2 771 468 (EP13818570.7), EP 2 764 103 (EP13824232.6), and EP 2 784 162 (EP14170383.5); and PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809), WO 2015/089351 (PCT/US2014/069897), WO 2015/089354 (PCT/US2014/069902), WO 2015/089364 (PCT/US2014/069925), WO 2015/089427 (PCT/US2014/070068), WO 2015/089462 (PCT/US2014/070127), WO 2015/089419 (PCT/US2014/070057), WO 2015/089465 (PCT/US2014/070135), WO 2015/089486 (PCT/US2014/070175), PCT/US2015/051691, PCT/US2015/051830. Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/835,973, 61/836,080, 61/836,101, and 61/836,127, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT/US2014/62558 filed Oct. 28, 2014, and U.S. Provisional Patent Applications Ser. Nos. 61/915,148, 61/915,150, 61/915,153, 61/915,203, 61/915,251, 61/915,301, 61/915,267, 61/915,260, and 61/915,397, each filed Dec. 12, 2013; 61/757,972 and 61/768,959, filed on Jan. 29, 2013 and Feb. 25, 2013; 62/010,888 and 62/010,879, both filed Jun. 11, 2014; 62/010,329, 62/010,439 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/055,484, 62/055,460 and 62/055,487, each filed Sep. 25, 2014; and 62/069,243, filed Oct. 27, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to PCT application designating, inter alia, the United States, application No. PCT/US14/41806, filed Jun. 10, 2014.

Mention is also made of U.S. application 62/180,709, 17 Jun. 2015, PROTECTED GUIDE RNAS (PGRNAS); U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. applications 62/091,462, 12 Dec. 2014, 62/096,324, 23 Dec. 2014, 62/180,681, 17 Jun. 2015, and 62/237,496, 5 Oct. 2015, DEAD GUIDES FOR CRISPR TRANSCRIPTION FACTORS; U.S. application 62/091,456, 12 Dec. 2014 and 62/180,692, 17 Jun. 2015, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014, 62/181,641, 18 Jun. 2015, and 62/181,667, 18 Jun. 2015, RNA-TARGETING SYSTEM; U.S. application 62/096,656, 24 Dec. 2014 and 62/181,151, 17 Jun. 2015, CRISPR HAVING OR ASSOCIATED WITH DESTABILIZATION DOMAINS; U.S. application 62/096,697, 24 Dec. 2014, CRISPR HAVING OR ASSOCIATED WITH AAV; U.S. application 62/098,158, 30 Dec. 2014, ENGINEERED CRISPR COMPLEX INSERTIONAL TARGETING SYSTEMS; U.S. application 62/151,052, 22 Apr. 2015, CELLULAR TARGETING FOR EXTRACELLULAR EXOSOMAL REPORTING; U.S. application 62/054,490, 24 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 61/939,154, 12-F EB-14, SYSTEMS, METHODS AND COMPOSITIONS FOR SEQUENCE MANIPULATION WITH OPTIMIZED FUNCTIONAL CRISPR-CAS SYSTEMS; U.S. application 62/055,484, 25 Sep. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. applications 62/054,675, 24 Sep. 2014 and 62/181,002, 17 Jun. 2015, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 2014, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 2014, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014 and 62/181,690, 18 Jun. 2015, FUNCTIONAL SCREENING WITH OPTIMIZED FUNCTIONAL CRISPR-CAS SYSTEMS; U.S. application 62/055,487, 25 Sep. 2014, FUNCTIONAL SCREENING WITH OPTIMIZED FUNCTIONAL CRISPR-CAS SYSTEMS; U.S. application 62/087,546, 4 Dec. 2014 and 62/181,687, 18 Jun. 2015, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN VIVO MODELING AND GENETIC SCREENING OF TUMOR GROWTH AND METASTASIS.

Mention is made of U.S. applications 62/181,659, 18 Jun. 2015 and 62/207,318, 19 Aug. 2015, ENGINEERING AND OPTIMIZATION OF SYSTEMS, METHODS, ENZYME AND GUIDE SCAFFOLDS OF CAS9 ORTHOLOGS AND VARIANTS FOR SEQUENCE MANIPULATION. Mention is made of U.S. applications 62/181,663, 18 Jun. 2015 and 62/245,264, 22 Oct. 2015, NOVEL CRISPR ENZYMES AND SYSTEMS, U.S. applications 62/181,675, 18 Jun. 2015, 62/285,349, 22 Oct. 2015, 62/296,522, 17 Feb. 2016, and 62/320,231, 8 Apr. 2016, NOVEL CRISPR ENZYMES AND SYSTEMS, U.S. application 62/232,067, 24 Sep. 2015, U.S. application Ser. No. 14/975,085, 18 Dec. 2015, European application No. 16150428.7, U.S. application 62/205,733, 16 Aug. 2015, U.S. application 62/201,542, 5 Aug. 2015, U.S. application 62/193,507, 16 Jul. 2015, and U.S. application 62/181,739, 18 Jun. 2015, each entitled NOVEL CRISPR ENZYMES AND SYSTEMS and of U.S. application 62/245,270, 22 Oct. 2015, NOVEL CRISPR ENZYMES AND SYSTEMS. Mention is also made of U.S. application 61/939,256, 12 Feb. 2014, and WO 2015/089473 (PCT/US2014/070152), 12 Dec. 2014, each entitled ENGINEERING OF SYSTEMS, METHODS AND OPTIMIZED GUIDE COMPOSITIONS WITH NEW ARCHITECTURES FOR SEQUENCE MANIPULATION. Mention is also made of PCT/US2015/045504, 15 Aug. 2015, U.S. application 62/180,699, 17 Jun. 2015, and U.S. application 62/038,358, 17 Aug. 2014, each entitled GENOME EDITING USING CAS9 NICKASES.

In addition, mention is made of PCT application PCT/US14/70057, and BI-2013/107 entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, and of PCT application PCT/US14/70127, and BI-2013/101 entitled "DELIVERY, USE AND THERAPEUTIC APPLICATIONS OF THE CRISPR-CAS SYSTEMS AND COMPOSITIONS FOR GENOME EDITING" (claiming priority from one or more or all of US provisional patent applications: 61/915,176; 61/915,192; 61/915,215; 61/915,107, 61/915,145; 61/915,148; and 61/915,153 each filed Dec. 12, 2013) ("the Eye PCT"), incorporated herein by reference, with respect to a method of preparing an sgRNA- and-Type V effector protein containing particle comprising admixing a mixture comprising an sgRNA and Type V effector protein (and optionally HDR template) with a mixture comprising or consisting essentially of or consisting of surfactant, phospholipid, biodegradable polymer, lipoprotein and alcohol; and particles from such a process. For example, wherein Type V effector protein and sgRNA were mixed together at a suitable, e.g., 3:1 to 1:3 or 2:1 to 1:2 or 1:1 molar ratio, at a suitable temperature, e.g., 15-30° C., e.g., 20-25° C., e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a C1-6 alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Type V effector protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Type V effector protein and components that form a particle; as well as particles from such admixing. Aspects of the instant invention can involve particles; for example, particles using a process analogous to that of the Particle Delivery PCT or that of the Eye PCT, e.g., by admixing a mixture comprising sgRNA and/or Type V effector as in the instant invention and components that form a particle, e.g., as in the Particle Delivery PCT or in the Eye PCT, to form a particle and particles from such admixing (or, of course, other particles involving sgRNA and/or Type V effector as in the instant invention).

Other Exemplary Nucleotide-Binding Systems and Proteins

In certain example embodiments, the nucleotide-binding molecule may be one or more components of systems that are not a CRISPR-Cas system. Examples of the other nucleotide-binding molecules may be components of transcription activator-like effector nuclease (TALEN), Zn finger nucleases, meganucleases, a functional fragment thereof, a variant thereof, or any combination thereof.

TALE Systems

In some embodiments, the system may comprise a transcription activator-like effector nuclease, a functional fragment thereof, or a variant thereof. The present disclosure may also include nucleotide sequences that are or encode one or more components of a TALE system. As disclosed herein editing can be made by way of the transcription activator-like effector nucleases (TALENs) system. Transcription activator-like effectors (TALEs) can be engineered to bind practically any desired DNA sequence. Exemplary methods of genome editing using the TALEN system can be found for example in Cermak T. Doyle E L. Christian M. Wang L. Zhang Y. Schmidt C, et al. Efficient design and assembly of custom TALEN and other TAL effector-based constructs for DNA targeting. Nucleic Acids Res. 2011; 39:e82; Zhang F. Cong L. Lodato S. Kosuri S. Church G M.

Arlotta P Efficient construction of sequence-specific TAL effectors for modulating mammalian transcription. Nat Biotechnol. 2011; 29:149-153 and U.S. Pat. Nos. 8,450,471, 8,440,431 and 8,440,432, all of which are specifically incorporated by reference.

In some embodiments, provided herein include isolated, non-naturally occurring, recombinant or engineered DNA binding proteins that comprise TALE monomers as a part of their organizational structure that enable the targeting of nucleic acid sequences with improved efficiency and expanded specificity.

Naturally occurring TALEs or "wild type TALEs" are nucleic acid binding proteins secreted by numerous species of proteobacteria. TALE polypeptides contain a nucleic acid binding domain composed of tandem repeats of highly conserved monomer polypeptides that are predominantly 33, 34 or 35 amino acids in length and that differ from each other mainly in amino acid positions 12 and 13. In advantageous embodiments the nucleic acid is DNA. As used herein, the term "polypeptide monomers", or "TALE monomers" will be used to refer to the highly conserved repetitive polypeptide sequences within the TALE nucleic acid binding domain and the term "repeat variable di-residues" or "RVD" will be used to refer to the highly variable amino acids at positions 12 and 13 of the polypeptide monomers. As provided throughout the disclosure, the amino acid residues of the RVD are depicted using the IUPAC single letter code for amino acids. A general representation of a TALE monomer which is comprised within the DNA binding domain is X1-11-(X12X13)-X14-33 or 34 or 35, where the subscript indicates the amino acid position and X represents any amino acid. X12X13 indicate the RVDs. In some polypeptide monomers, the variable amino acid at position 13 is missing or absent and in such polypeptide monomers, the RVD consists of a single amino acid. In such cases the RVD may be alternatively represented as X*, where X represents X12 and (*) indicates that X13 is absent. The DNA binding domain comprises several repeats of TALE monomers and this may be represented as (X1-11-(X12X13)-X14-33 or 34 or 35)z, where in an advantageous embodiment, z is at least 5 to 40. In a further advantageous embodiment, z is at least 10 to 26.

The TALE monomers have a nucleotide binding affinity that is determined by the identity of the amino acids in its RVD. For example, polypeptide monomers with an RVD of NI preferentially bind to adenine (A), polypeptide monomers with an RVD of NG preferentially bind to thymine (T), polypeptide monomers with an RVD of HD preferentially bind to cytosine (C) and polypeptide monomers with an RVD of NN preferentially bind to both adenine (A) and guanine (G). In yet another embodiment of the invention, polypeptide monomers with an RVD of IG preferentially bind to T. Thus, the number and order of the polypeptide monomer repeats in the nucleic acid binding domain of a TALE determines its nucleic acid target specificity. In still further embodiments of the invention, polypeptide monomers with an RVD of NS recognize all four base pairs and may bind to A, T, G or C. The structure and function of TALEs is further described in, for example, Moscou et al., Science 326:1501 (2009); Boch et al., Science 326:1509-1512 (2009); and Zhang et al., Nature Biotechnology 29:149-153 (2011), each of which is incorporated by reference in its entirety.

The TALE polypeptides used in methods of the invention are isolated, non-naturally occurring, recombinant or engineered nucleic acid-binding proteins that have nucleic acid or DNA binding regions containing polypeptide monomer repeats that are designed to target specific nucleic acid sequences.

As described herein, polypeptide monomers having an RVD of HN or NH preferentially bind to guanine and thereby allow the generation of TALE polypeptides with high binding specificity for guanine containing target nucleic acid sequences. In a preferred embodiment of the invention, polypeptide monomers having RVDs RN, NN, NK, SN, NH, KN, HN, NQ, HH, RG, KH, RH and SS preferentially bind to guanine. In a much more advantageous embodiment of the invention, polypeptide monomers having RVDs RN, NK, NQ, HH, KH, RH, SS and SN preferentially bind to guanine and thereby allow the generation of TALE polypeptides with high binding specificity for guanine containing target nucleic acid sequences. In an even more advantageous embodiment of the invention, polypeptide monomers having RVDs HH, KH, NH, NK, NQ, RH, RN and SS preferentially bind to guanine and thereby allow the generation of TALE polypeptides with high binding specificity for guanine containing target nucleic acid sequences. In a further advantageous embodiment, the RVDs that have high binding specificity for guanine are RN, NH RH and KH. Furthermore, polypeptide monomers having an RVD of NV preferentially bind to adenine and guanine. In more preferred embodiments of the invention, polypeptide monomers having RVDs of H*, HA, KA, N*, NA, NC, NS, RA, and S* bind to adenine, guanine, cytosine and thymine with comparable affinity.

The predetermined N-terminal to C-terminal order of the one or more polypeptide monomers of the nucleic acid or DNA binding domain determines the corresponding predetermined target nucleic acid sequence to which the TALE polypeptides will bind. As used herein the polypeptide monomers and at least one or more half polypeptide monomers are "specifically ordered to target" the genomic locus or gene of interest. In plant genomes, the natural TALE-binding sites always begin with a thymine (T), which may be specified by a cryptic signal within the non-repetitive N-terminus of the TALE polypeptide; in some cases this region may be referred to as repeat 0. In animal genomes, TALE binding sites do not necessarily have to begin with a thymine (T) and TALE polypeptides may target DNA sequences that begin with T, A, G or C. The tandem repeat of TALE monomers always ends with a half-length repeat or a stretch of sequence that may share identity with only the first 20 amino acids of a repetitive full length TALE monomer and this half repeat may be referred to as a half-monomer (FIG. 8), which is included in the term "TALE monomer". Therefore, it follows that the length of the nucleic acid or DNA being targeted is equal to the number of full polypeptide monomers plus two.

As described in Zhang et al., Nature Biotechnology 29:149-153 (2011), TALE polypeptide binding efficiency may be increased by including amino acid sequences from the "capping regions" that are directly N-terminal or C-terminal of the DNA binding region of naturally occurring TALEs into the engineered TALEs at positions N-terminal or C-terminal of the engineered TALE DNA binding region. Thus, in certain embodiments, the TALE polypeptides described herein further comprise an N-terminal capping region and/or a C-terminal capping region.

An exemplary amino acid sequence of a N-terminal capping region is:

```
                                          (SEQ ID NO: 392)
MDPIRSRTPSPARELLSGPQPDGVQPTADRGVSP

PAGGPLDGLPARRTMSRTRLPSPPAPSPAFSADS

FSDLLRQFDPSLFNTSLFDSLPPFGAHHTEAATG

EWDEVQSGLRAADAPPPTMRVAVTAARPPRAKPA

PRRRAAQPSDASPAAQVDLRTLGYSQQQQEKIKP

KVRSTVAQHHEALVGHGFTHAHIVALSQHPAALG

TVAVKYQDMIAALPEATHEAIVGVGKQWSGARAL

EALLTVAGELRGPPLQLDTGQLLKIAKRGGVTAV

EAVHAWRNALTGAPLN
```

An exemplary amino acid sequence of a C-terminal capping region is:

```
                                          (SEQ ID NO: 393)
RPALESIVAQLSRPDPALAALTNDHLVALACLG

GRPALDAVKKGLPHAPALIKRTNRRIPERTSHR

VADHAQVVRVLGFFQCHSHPAQAFDDAMTQFGM

SRHGLLQLFRRVGVTELEARSGTLPPASQRWDR

ILQASGMKRAKPSPTSTQTPDQASLHAFADSLE

RDLDAPSPMHEGDQTRAS
```

As used herein, the predetermined "N-terminus" to "C terminus" orientation of the N-terminal capping region, the DNA binding domain comprising the repeat TALE monomers and the C-terminal capping region provide structural basis for the organization of different domains in the d-TALEs or polypeptides of the invention.

The entire N-terminal and/or C-terminal capping regions are not necessary to enhance the binding activity of the DNA binding region. Therefore, in certain embodiments, fragments of the N-terminal and/or C-terminal capping regions are included in the TALE polypeptides described herein.

In certain embodiments, the TALE polypeptides described herein contain a N-terminal capping region fragment that included at least 10, 20, 30, 40, 50, 54, 60, 70, 80, 87, 90, 94, 100, 102, 110, 117, 120, 130, 140, 147, 150, 160, 170, 180, 190, 200, 210, 220, 230, 240, 250, 260 or 270 amino acids of an N-terminal capping region. In certain embodiments, the N-terminal capping region fragment amino acids are of the C-terminus (the DNA-binding region proximal end) of an N-terminal capping region. As described in Zhang et al., Nature Biotechnology 29:149-153 (2011), N-terminal capping region fragments that include the C-terminal 240 amino acids enhance binding activity equal to the full length capping region, while fragments that include the C-terminal 147 amino acids retain greater than 80% of the efficacy of the full length capping region, and fragments that include the C-terminal 117 amino acids retain greater than 50% of the activity of the full-length capping region.

In some embodiments, the TALE polypeptides described herein contain a C-terminal capping region fragment that included at least 6, 10, 20, 30, 37, 40, 50, 60, 68, 70, 80, 90, 100, 110, 120, 127, 130, 140, 150, 155, 160, 170, 180 amino acids of a C-terminal capping region. In certain embodiments, the C-terminal capping region fragment amino acids are of the N-terminus (the DNA-binding region proximal end) of a C-terminal capping region. As described in Zhang et al., Nature Biotechnology 29:149-153 (2011), C-terminal capping region fragments that include the C-terminal 68 amino acids enhance binding activity equal to the full length capping region, while fragments that include the C-terminal 20 amino acids retain greater than 50% of the efficacy of the full length capping region.

In certain embodiments, the capping regions of the TALE polypeptides described herein do not need to have identical sequences to the capping region sequences provided herein. Thus, in some embodiments, the capping region of the TALE polypeptides described herein have sequences that are at least 50%, 60%, 70%, 80%, 85%, 90%, 91%, 92%, 93%, 94%, 95%, 96%, 97%, 98% or 99% identical or share identity to the capping region amino acid sequences provided herein. Sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences. In some preferred embodiments, the capping region of the TALE polypeptides described herein have sequences that are at least 95% identical or share identity to the capping region amino acid sequences provided herein.

Sequence homologies may be generated by any of a number of computer programs known in the art, which include but are not limited to BLAST or FASTA. Suitable computer program for carrying out alignments like the GCG Wisconsin Bestfit package may also be used. Once the software has produced an optimal alignment, it is possible to calculate % homology, preferably % sequence identity. The software typically does this as part of the sequence comparison and generates a numerical result.

In some embodiments described herein, the TALE polypeptides of the invention include a nucleic acid binding domain linked to the one or more effector domains. The terms "effector domain" or "regulatory and functional domain" refer to a polypeptide sequence that has an activity other than binding to the nucleic acid sequence recognized by the nucleic acid binding domain. By combining a nucleic acid binding domain with one or more effector domains, the polypeptides of the invention may be used to target the one or more functions or activities mediated by the effector domain to a particular target DNA sequence to which the nucleic acid binding domain specifically binds.

In some embodiments of the TALE polypeptides described herein, the activity mediated by the effector domain is a biological activity. For example, in some embodiments the effector domain is a transcriptional inhibitor (i.e., a repressor domain), such as an mSin interaction domain (SID). SID4X domain or a Kruppel-associated box (KRAB) or fragments of the KRAB domain. In some embodiments the effector domain is an enhancer of transcription (i.e. an activation domain), such as the VP16, VP64 or p65 activation domain. In some embodiments, the nucleic acid binding is linked, for example, with an effector domain that includes, but is not limited to, a transposase, integrase, recombinase, resolvase, invertase, protease, DNA methyltransferase, DNA demethylase, histone acetylase, histone deacetylase, nuclease, transcriptional repressor, transcriptional activator, transcription factor recruiting, protein nuclear-localization signal or cellular uptake signal.

In some embodiments, the effector domain is a protein domain which exhibits activities which include but are not limited to transposase activity, integrase activity, recombinase activity, resolvase activity, invertase activity, protease activity, DNA methyltransferase activity, DNA demethylase activity, histone acetylase activity, histone deacetylase activity, nuclease activity, nuclear-localization signaling activity, transcriptional repressor activity, transcriptional activator activity, transcription factor recruiting activity, or cellular uptake signaling activity. Other preferred embodiments of the invention may include any combination the activities described herein.

Zn-Finger Nucleases

In some embodiments, the system may comprise a Zn-finger nuclease, a functional fragment thereof, or a variant thereof. The composition may comprise one or more Zn-finger nucleases or nucleic acids encoding thereof. In some cases, the nucleotide sequences may comprise coding sequences for Zn-Finger nucleases. Other preferred tools for genome editing for use in the context of this invention include zinc finger systems and TALE systems. One type of programmable DNA-binding domain is provided by artificial zinc-finger (ZF) technology, which involves arrays of ZF modules to target new DNA-binding sites in the genome. Each finger module in a ZF array targets three DNA bases. A customized array of individual zinc finger domains is assembled into a ZF protein (ZFP).

ZFPs can comprise a functional domain. The first synthetic zinc finger nucleases (ZFNs) were developed by fusing a ZF protein to the catalytic domain of the Type IIS restriction enzyme FokI. (Kim, Y. G. et al., 1994, Chimeric restriction endonuclease, Proc. Natl. Acad. Sci. U.S.A. 91, 883-887; Kim, Y. G. et al., 1996, Hybrid restriction enzymes: zinc finger fusions to Fok I cleavage domain. Proc. Natl. Acad. Sci. U.S.A. 93, 1156-1160). Increased cleavage specificity can be attained with decreased off target activity by use of paired ZFN heterodimers, each targeting different nucleotide sequences separated by a short spacer. (Doyon, Y. et al., 2011, Enhancing zinc-finger-nuclease activity with improved obligate heterodimeric architectures. Nat. Methods 8, 74-79). ZFPs can also be designed as transcription activators and repressors and have been used to target many genes in a wide variety of organisms. Exemplary methods of genome editing using ZFNs can be found for example in U.S. Pat. Nos. 6,534,261, 6,607,882, 6,746,838, 6,794,136, 6,824,978, 6,866,997, 6,933,113, 6,979,539, 7,013,219, 7,030,215, 7,220,719, 7,241,573, 7,241,574, 7,585,849, 7,595,376, 6,903,185, and 6,479,626, all of which are specifically incorporated by reference.

Meganucleases

In some embodiments, the system may comprise a meganuclease, a functional fragment thereof, or a variant thereof. The composition may comprise one or more meganucleases or nucleic acids encoding thereof. As disclosed herein, editing can be made by way of meganucleases, which are endodeoxyribonucleases characterized by a large recognition site (double-stranded DNA sequences of 12 to 40 base pairs). In some cases, the nucleotide sequences may comprise coding sequences for meganucleases. Exemplary methods for using meganucleases can be found in U.S. Pat. Nos. 8,163,514; 8,133,697; 8,021,867; 8,119,361; 8,119,381; 8,124,369; and 8,129,134, which are specifically incorporated by reference.

In certain embodiments, any of the nucleases, including the modified nucleases as described herein, may be used in the methods, compositions, and kits according to the invention. In particular embodiments, nuclease activity of an unmodified nuclease may be compared with nuclease activity of any of the modified nucleases as described herein, e.g. to compare for instance off-target or on-target effects. Alternatively, nuclease activity (or a modified activity as described herein) of different modified nucleases may be compared, e.g. to compare for instance off-target or on-target effects.

Linkers

The transposase(s) and the Cas protein(s) may be associated via a linker. The term "linker" refers to a molecule which joins the proteins to form a fusion protein. Generally, such molecules have no specific biological activity other than to join or to preserve some minimum distance or other spatial relationship between the proteins. However, in certain embodiments, the linker may be selected to influence some property of the linker and/or the fusion protein such as the folding, net charge, or hydrophobicity of the linker.

Suitable linkers for use in the methods herein include straight or branched-chain carbon linkers, heterocyclic carbon linkers, or peptide linkers. However, as used herein the linker may also be a covalent bond (carbon-carbon bond or carbon-heteroatom bond). In particular embodiments, the linker is used to separate the Cas protein and the transposase by a distance sufficient to ensure that each protein retains its required functional property. A peptide linker sequences may adopt a flexible extended conformation and do not exhibit a propensity for developing an ordered secondary structure. In certain embodiments, the linker can be a chemical moiety which can be monomeric, dimeric, multimeric or polymeric. Preferably, the linker comprises amino acids. Typical amino acids in flexible linkers include Gly, Asn and Ser. Accordingly, in particular embodiments, the linker comprises a combination of one or more of Gly, Asn and Ser amino acids. Other near neutral amino acids, such as Thr and Ala, also may be used in the linker sequence. Exemplary linkers are disclosed in Maratea et al. (1985), Gene 40: 39-46; Murphy et al. (1986) Proc. Nat'l. Acad. Sci. USA 83: 8258-62; U.S. Pat. Nos. 4,935,233; and 4,751,180. For example, GlySer linkers GGS, GGGS (SEQ ID NO:394) or GSG can be used. GGS, GSG, GGGS or GGGGS (SEQ ID NO:373) linkers can be used in repeats of 3 (such as $(GGS)_3$, (SEQ ID NO:395) $(GGGGS)_3$ (SEQ ID NO:396)) or 5, 6, 7, 9 or even 12 or more, to provide suitable lengths. In some cases, the linker may be $(GGGGS)_{3-15}$, For example, in some cases, the linker may be $(GGGGS)_{3-1}$, e.g., GGGGS, $(GGGGS)_2$ (SEQ ID NO:397), $(GGGGS)_3$, $(GGGGS)_4$ (SEQ ID NO:398), $(GGGGS)_5$ (SEQ ID NO:399), $(GGGGS)_6$ (SEQ ID NO:400), $(GGGGS)_7$ (SEQ ID NO:401), $(GGGGS)_8$ (SEQ ID NO:402), $(GGGGS)_9$ (SEQ ID NO:403), $(GGGGS)_{10}$ (SEQ ID NO:404), or $(GGGGS)_{11}$ (SEQ ID NO:405).

In particular embodiments, linkers such as $(GGGGS)_3$ are preferably used herein. $(GGGGS)_6$ $(GGGGS)_9$ or $(GGGGS)_{12}$ (SEQ ID NO:406) may preferably be used as alternatives. Other preferred alternatives are $(GGGGS)_1$, $(GGGGS)_2$, $(GGGGS)_4$, $(GGGGS)_5$, $(GGGGS)_7$, $(GGGGS)_8$, $(GGGGS)_{10}$, or $(GGGGS)_{11}$. In yet a further embodiment, LEPGEKPYKCPECGKSFSQSGALTRHQRTHTR (SEQ ID NO:407) is used as a linker. In particular embodiments, the CRISPR-cas protein is a Cas protein and is linked to the transposase or its catalytic domain by means of an LEPGEKPYKCPECGKSFSQSGALTRHQRTHTR (SEQ ID NO:408) linker. In further particular embodiments, the Cas protein is linked C-terminally to the N-terminus of a transposase or its catalytic domain by means of an LEPGEKPYKCPECGKSFSQSGALTRHQRTHTR (SEQ ID NO:409) linker. In addition, N- and C-terminal NLSs can also function as linker (e.g., PKKKRKVEASPKKRKVEAS (SEQ ID NO:410)).

In yet an additional embodiment, the linker is an XTEN linker. The linker may comprise one or more repeats of XTEN linkers, e.g., 1, 2, 3, 4, 5, 6, 7, 8, 9, 10, 11, 12, 13, 14, 15, 16, 17, 18, 19, 20, or more repeats of XTEN linkers.

Different transposases may need linkers of different sizes to be associated with a Cas protein. For example, TsnB may need a longer linker than TnsQ when associated with a Cas protein.

Examples of linkers are shown in the Table 3 below.

TABLE 3

| | |
|---|---|
| GGS | GGTGGTAGT (SEQ ID NO: 411) |
| GGSx3 (9) | GGTGGTAGTGGAGGGAGCGGCGGTTCA (SEQ ID NO: 412) |
| GGSx7 (21) | ggtggaggaggctctggtggaggcggtagcggaggcggagggtcgGGTGGTAGTGGAGGG AGCGGCGGTTCA (SEQ ID NO: 413) |
| XTEN | TCGGGATCTGAGACGCCTGGGACCTCGGAATCGGCTACGCCCGAA AGT (SEQ ID NO: 414) |
| Z-EGFR_Short | Gtggataacaaatttaacaaagaaatgtgggcggcgtgggaagaaattcgtaacctgccgaacctgaacggctggcagatgaccgcgtttattgcgagcctggtggatgatccgagccagagcgcgaacctgctggcggaagcgaaaaaactgaacgatgcgcaggcgccgaaaaccggcggtggttctggt (SEQ ID NO: 415) |
| GSAT | Ggtggttctgccggtggctccggttctggctccagcggtggcagctctggtgcgtccggcacgggtactgcgggtggcactggcagcggttccggtactggctctggc (SEQ ID NO: 416) |

Vector Systems

The present disclosure provides vector systems comprising one or more vectors. A vector may comprise one or more polynucleotides encoding components in the Cas associated transposases systems herein, or combination thereof. In a particular example, the present disclosure provides a single vector comprising all components of the Cas-associated transposase system or polynucleotides encoding the components. The vector may comprise a single promoter. In other embodiments, the system may comprise a plurality of vectors, each comprising one or some components the Cas-associated transposase system or polynucleotides encoding the components.

The one or more polynucleotides in the vector systems may comprise one or more regulatory elements operably configures to express the polypeptide(s) and/or the nucleic acid component(s), optionally wherein the one or more regulatory elements comprise inducible promoters. The polynucleotide molecule encoding the Cas polypeptide is codon optimized for expression in a eukaryotic cell.

Polynucleotides encoding the Cas and/or transposase(s) may be mutated to reduce or prevent early or pre-mature termination of translation. In some embodiments, the polynucleotides encode RNA with poly-U stretches (e.g., in the 5' end). Such polynucleotides may be mutated, e.g., in the sequences encoding the poly-U stretches, to reduce or prevent early or pre-mature termination.

As described previously and as used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes one or more expression control sequences, and an "expression control sequence" is a DNA sequence that controls and regulates the transcription and/or translation of another DNA sequence.

Suitable expression vectors include, without limitation, plasmids and viral vectors derived from, for example, bacteriophage, baculoviruses, tobacco mosaic virus, herpes viruses, cytomegalovirus, retroviruses, vaccinia viruses, adenoviruses, and adeno-associated viruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.). By way of example, some vectors used in recombinant DNA techniques allow entities, such as a segment of DNA (such as a heterologous DNA segment, such as a heterologous cDNA segment), to be transferred into a target cell. The present invention comprehends recombinant vectors that may include viral vectors, bacterial vectors, protozoan vectors, DNA vectors, or recombinants thereof. With regards to recombination and cloning methods, mention is made of U.S. patent application Ser. No. 10/815,730, the contents of which are herein incorporated by reference in their entirety.

A vector may have one or more restriction endonuclease recognition sites (e.g., type I, II or IIs) at which the sequences may be cut in a determinable fashion without loss of an essential biological function of the vector, and into which a nucleic acid fragment may be spliced or inserted in order to bring about its replication and cloning. Vectors may also comprise one or more recombination sites that permit exchange of nucleic acid sequences between two nucleic acid molecules. Vectors may further provide primer sites, e.g., for PCR, transcriptional and/or translational initiation and/or regulation sites, recombinational signals, replicons, selectable markers, etc. A vector may further contain one or more selectable markers suitable for use in the identification of cells transformed with the vector.

As mentioned previously, vectors capable of directing the expression of genes and/or nucleic acid sequence to which they are operatively linked, in an appropriate host cell (e.g., a prokaryotic cell, eukaryotic cell, or mammalian cell), are referred to herein as "expression vectors." If translation of the desired nucleic acid sequence is required, the vector also typically may comprise sequences required for proper translation of the nucleotide sequence. The term "expression" as used herein with regards to expression vectors, refers to the biosynthesis of a nucleic acid sequence product, i.e., to the transcription and/or translation of a nucleotide sequence. Expression also refers to biosynthesis of a microRNA or RNAi molecule, which refers to expression and transcription of an RNAi agent such as siRNA, shRNA, and antisense DNA, that do not require translation to polypeptide sequences.

In general, expression vectors of utility in the methods of generating and compositions which may comprise polypeptides of the invention described herein are often in the form of "plasmids," which refer to circular double-stranded DNA loops which, in their vector form, are not bound to a chromosome. In some embodiments of the aspects described herein, all components of a given polypeptide may be encoded in a single vector. For example, in some embodiments, a vector may be constructed that contains or may comprise all components necessary for a functional polypeptide as described herein. In some embodiments, individual components (e.g., one or more monomer units and one or more effector domains) may be separately encoded in different vectors and introduced into one or more cells separately. Moreover, any vector described herein may itself comprise predetermined Cas and/or retrotransposon polypeptides encoding component sequences, such as an effector domain and/or other polypeptides, at any location or combination of locations, such as 5' to, 3' to, or both 5' and 3' to the exogenous nucleic acid molecule which may comprise one or more component Cas and/or retrotransposon polypeptides encoding sequences to be cloned in. Such expression vectors are termed herein as which may comprise "backbone sequences."

Several embodiments of the invention relate to vectors that include but are not limited to plasmids, episomes, bacteriophages, or viral vectors, and such vectors may integrate into a host cell's genome or replicate autonomously in the particular cellular system used. In some embodiments of the compositions and methods described herein, the vector used is an episomal vector, i.e., a nucleic acid capable of extra-chromosomal replication and may include sequences from bacteria, viruses or phages. Other embodiments of the invention relate to vectors derived from bacterial plasmids, bacteriophages, yeast episomes, yeast chromosomal elements, and viruses, vectors derived from combinations thereof, such as those derived from plasmid and bacteriophage genetic elements, cosmids and phagemids. In some embodiments, a vector may be a plasmid, bacteriophage, bacterial artificial chromosome (BAC) or yeast artificial chromosome (YAC). A vector may be a single- or double-stranded DNA, RNA, or phage vector.

Viral vectors include, but are not limited to, retroviral vectors, such as lentiviral vectors or gammaretroviral vectors, adenoviral vectors, and baculoviral vectors. For example, a lentiviral vector may be used in the form of lentiviral particles. Other forms of expression vectors known by those skilled in the art which serve equivalent functions may also be used. Expression vectors may be used for stable or transient expression of the polypeptide encoded by the nucleic acid sequence being expressed. A vector may be a self-replicating extrachromosomal vector or a vector which integrates into a host genome. One type of vector is a genomic integrated vector, or "integrated vector", which may become integrated into the chromosomal DNA or RNA of a host cell, cellular system, or non-cellular system. In some embodiments, the nucleic acid sequence encoding the Cas and/or retrotransposon polypeptides described herein, integrates into the chromosomal DNA or RNA of a host cell, cellular system, or non-cellular system along with components of the vector sequence.

The recombinant expression vectors used herein comprise a Cas and/or retrotransposon nucleic acid in a form suitable for expression of the nucleic acid in a host cell, which indicates that the recombinant expression vector(s) include one or more regulatory sequences, selected on the basis of the host cell(s) to be used for expression, which is operatively linked to the nucleic acid sequence to be expressed.

In advantageous embodiments of the invention, the expression vectors described herein may be introduced into host cells to thereby produce proteins or peptides, including fusion proteins or peptides, encoded by nucleic acids as described herein (e.g., Cas and/or retrotransposon polypeptides, or variant forms thereof).

In some embodiments, the recombinant expression vectors which may comprise a nucleic acid encoding a Cas and/or transposase described herein further comprise a 5'UTR sequence and/or a 3' UTR sequence, thereby providing the nucleic acid sequence transcribed from the expression vector additional stability and translational efficiency.

Certain embodiments of the invention may relate to the use of prokaryotic vectors and variants and derivatives thereof. Other embodiments of the invention may relate to the use of eukaryotic expression vectors. With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety.

In some embodiments of the aspects described herein, a Cas and/or transposase is expressed using a yeast expression vector. Examples of vectors for expression in yeast S. cerivisae include, but are not limited to, pYepSec1 (Baldari, et al., (1987) EMBO J. 6:229-234), pMFa (Kurjan and Herskowitz, (1982) Cell 30:933-943), pJRY88 (Schultz et al., (1987) Gene 54:113-123), and pYES2 (Invitrogen Corporation, San Diego, Calif.).

In other embodiments of the invention, Cas and/or transpoase are expressed in insect cells using, for example, baculovirus expression vectors. Baculovirus vectors available for expression of proteins in cultured insect cells (e.g., Sf 9 cells) include, but are not limited to, the pAc series (Smith et al. (1983) Mol. Cell Biol. 3:2156-2165) and the pVL series (Lucklow and Summers (1989) Virology 170: 31-39).

In some embodiments of the aspects described herein, Cas and/or transposase are expressed in mammalian cells using a mammalian expression vector. Non-limiting examples of mammalian expression vectors include pCDM8 (Seed, B. (1987) Nature 329:840) and pMT2PC (Kaufman et al. (1987) EMBO J. 6:187-195). When used in mammalian cells, the expression vector's control functions are often provided by viral regulatory elements. For example, commonly used promoters are derived from polyoma, Adenovirus 2, cytomegalovirus and Simian Virus 40. With regards to viral regulatory elements, mention is made of U.S. patent application Ser. No. 13/248,967, the contents of which are incorporated by reference herein in their entirety.

In some such embodiments, the mammalian expression vector is capable of directing expression of the nucleic acid encoding the Cas and/or transposase in a particular cell type (e.g., tissue-specific regulatory elements are used to express the nucleic acid). Tissue-specific regulatory elements are known in the art and in this regard, mention is made of U.S. Pat. No. 7,776,321, the contents of which are incorporated by reference herein in their entirety.

The vectors which may comprise nucleic acid sequences encoding the Cas and/or transposase described herein may be "introduced" into cells as polynucleotides, preferably DNA, by techniques well known in the art for introducing DNA and RNA into cells. The term "transduction" refers to any method whereby a nucleic acid sequence is introduced into a cell, e.g., by transfection, lipofection, electroporation (methods whereby an instrument is used to create micro-sized holes transiently in the plasma membrane of cells under an electric discharge, see, e.g., Banerjee et al., Med. Chem. 42:4292-99 (1999); Godbey et al., Gene Ther. 6:1380-88 (1999); Kichler et al., Gene Ther. 5:855-60 (1998); Birchaa et al., J. Pharm. 183:195-207 (1999)), biolistics, passive uptake, lipid:nucleic acid complexes, viral vector transduction, injection, contacting with naked DNA, gene gun (whereby the nucleic acid is coupled to a nanoparticle of an inert solid (commonly gold) which is then "shot" directly into the target cell's nucleus), calcium phosphate, DEAE dextran, lipofectin, lipofectamine, DIMRIE C, Superfect, and Effectin (Qiagen), unifectin, maxifectin, DOTMA, DOGS (Transfectam; dioctadecylamidoglycyl-spermine), DOPE (1,2-dioleoyl-sn-glycero-3-phosphoethanolamine), DOTAP (1,2-dioleoyl-3-trimethylammonium propane), DDAB (dimethyl dioctadecylammonium bromide), DHDEAB (N,N-di-n-hexadecyl-N,N-dihydroxyethyl ammonium bromide), HDEAB (N-n-hexadecyl-N,N-dihydroxyethylammonium bromide), polybrene, poly(ethylenimine) (PEI), sono-poration (transfection via the application of sonic forces to cells), optical transfection (methods whereby a tiny (~1 μm diameter) hole is transiently generated in the plasma membrane of a cell using a highly focused laser), magnetofection (refers to a transfection method, that uses magnetic force to deliver exogenous nucleic acids coupled to magnetic nanoparticles into target cells), impalefection (carried out by impaling cells by elongated nanostructures, such as carbon nanofibers or silicon nanowires which were coupled to exogenous nucleic acids), and the like. In this regard, mention is made of U.S. patent application Ser. No. 13/088,009, the contents of which are incorporated by reference herein in their entirety.

The nucleic acid sequences encoding the Cas and/or transposase or the vectors which may comprise the nucleic acid sequences encoding the Cas and/or transposase described herein may be introduced into a cell using any method known to one of skill in the art. The term "transformation" as used herein refers to the introduction of genetic material (e.g., a vector which may comprise a nucleic acid sequence encoding a Cas and/or transposase) into a cell, tissue or organism. Transformation of a cell may be stable or transient. The term "transient transformation" or "transiently transformed" refers to the introduction of one or more transgenes into a cell in the absence of integration of the transgene into the host cell's genome. Transient transformation may be detected by, for example, enzyme-linked immunosorbent assay (ELISA), which detects the presence of a polypeptide encoded by one or more of the transgenes. For example, a nucleic acid sequence encoding Cas and/or transposase may further comprise a constitutive promoter operably linked to a second output product, such as a reporter protein. Expression of that reporter protein indicates that a cell has been transformed or transfected with the nucleic acid sequence encoding Cas and/or transposase. Alternatively, or in combination, transient transformation may be detected by detecting the activity of the Cas and/or transposase. The term "transient transformant" refers to a cell which has transiently incorporated one or more transgenes.

In contrast, the term "stable transformation" or "stably transformed" refers to the introduction and integration of one or more transgenes into the genome of a cell or cellular system, preferably resulting in chromosomal integration and stable heritability through meiosis. Stable transformation of a cell may be detected by Southern blot hybridization of genomic DNA of the cell with nucleic acid sequences, which are capable of binding to one or more of the transgenes. Alternatively, stable transformation of a cell may also be detected by the polymerase chain reaction of genomic DNA of the cell to amplify transgene sequences. The term "stable transformant" refers to a cell, which has stably integrated one or more transgenes into the genomic DNA. Thus, a stable transformant is distinguished from a transient transformant in that, whereas genomic DNA from the stable transformant contains one or more transgenes, genomic DNA from the transient transformant does not contain a transgene. Transformation also includes introduction of genetic material into plant cells in the form of plant viral vectors involving epichromosomal replication and gene expression, which may exhibit variable properties with respect to meiotic stability. Transformed cells, tissues, or plants are understood to encompass not only the end product of a transformation process, but also transgenic progeny thereof.

For stable transfection of mammalian cells, it is known that, depending upon the expression vector and transfection technique used, only a small fraction of cells may integrate the foreign DNA into their genome. In order to identify and select these integrants, a gene that encodes a selectable biomarker (e.g., resistance to antibiotics) is generally introduced into the host cells along with the gene of interest. Selectable markers include those which confer resistance to drugs, such as G418, hygromycin and methotrexate. Nucleic acid encoding a selectable biomarker may be introduced into a host cell on the same vector as that encoding Cas and/or transposase or may be introduced on a separate vector. Cells stably transfected with the introduced nucleic acid may be identified by drug selection (e.g., cells that have incorporated the selectable biomarker gene survive, while the other cells die). With regard to transformation, mention is made to U.S. Pat. No. 6,620,986, the contents of which are incorporated by reference herein in their entirety.

Regulatory Sequences and Promoters

As used herein, the term "regulatory sequence" is intended to include promoters, enhancers and other expression control elements (e.g., 5' and 3' untranslated regions (UTRs) and polyadenylation signals). With regard to regulatory sequences, mention is made of U.S. patent application Ser. No. 10/491,026, the contents of which are incorporated by reference herein in their entirety.

The terms "promoter", "promoter element" or "promoter sequence" are equivalents and as used herein refer to a DNA sequence which, when operatively linked to a nucleotide sequence of interest, is capable of controlling the transcription of the nucleotide sequence of interest into mRNA. Promoters may be constitutive, inducible or regulatable. The term "tissue-specific" as it applies to a promoter refers to a promoter that is capable of directing selective expression of a nucleotide sequence of interest to a specific type of tissue in the relative absence of expression of the same nucleotide sequence of interest in a different type of tissue. Tissue specificity of a promoter may be evaluated by methods known in the art. The term "cell-type specific" as applied to a promoter refers to a promoter, which is capable of directing selective expression of a nucleotide sequence of interest in a specific type of cell in the relative absence of expression of the same nucleotide sequence of interest in a different type of cell within the same tissue. The term "cell-type specific" when applied to a promoter also means a promoter capable of promoting selective expression of a nucleotide sequence of interest in a region within a single tissue.

Cell-type specificity of a promoter may be assessed using methods well known in the art., e.g., GUS activity staining or immunohistochemical staining. The term "minimal promoter" as used herein refers to the minimal nucleic acid sequence which may comprise a promoter element while also maintaining a functional promoter. A minimal promoter may comprise an inducible, constitutive or tissue-specific promoter. With regards to promoters, mention is made of PCT publication WO 2011/028929 and U.S. application Ser. No. 12/511,940, the contents of which are incorporated by reference herein in their entirety.

In some cases, the promoter may be suitable for polynucleotide encoding RNA molecules with poly-U stretches. Such promoter may reduce the early termination caused by the poly-U stretches in RNA.

In some cases, the promoter may be a constitutive promoter, e.g., U6 and H1 promoters, retroviral Rous sarcoma virus (RSV) LTR promoter, cytomegalovirus (CMV) promoter, SV40 promoter, dihydrofolate reductase promoter, β-actin promoter, phosphoglycerol kinase (PGK) promoter, ubiquitin C, U5 snRNA, U7 snRNA, tRNA promoters or EF1α promoter. In certain cases, the promoter may be a tissue-specific promoter and may direct expression primarily in a desired tissue of interest, such as muscle, neuron, bone, skin, blood, specific organs (e.g. liver, pancreas), or particular cell types (e.g. lymphocytes). Examples of tissue-specific promoters include lck, myogenin, or thy1 promoters. In some embodiments, the promoter may direct expression in a temporal-dependent manner, such as in a cell-cycle dependent or developmental stage-dependent manner, which may or may not also be tissue or cell-type specific. In certain cases, the promoter may be an inducible promoter, e.g., can be activated by a chemical such as doxycycline.

In some cases, the promoters may be cell-specific, tissue-specific, or organ-specific promoters. Example of cell-specific, tissue-specific, or organ-specific promoters include promoter for creatine kinase, (for expression in muscle and cardiac tissue), immunoglobulin heavy or light chain promoters (for expression in B cells), and smooth muscle alpha-actin promoter. Exemplary tissue-specific promoters for the liver include HMG-COA reductase promoter, sterol regulatory element 1, phosphoenol pyruvate carboxy kinase (PEPCK) promoter, human C-reactive protein (CRP) promoter, human glucokinase promoter, cholesterol 7-alpha hydroylase (CYP-7) promoter, beta-galactosidase alpha-2,6 sialyltransferase promoter, insulin-like growth factor binding protein (IGFBP-1) promoter, aldolase B promoter, human transferrin promoter, and collagen type I promoter. Exemplary tissue-specific promoters for the prostate include the prostatic acid phosphatase (PAP) promoter, prostatic secretory protein of 94 (PSP 94) promoter, prostate specific antigen complex promoter, and human glandular kallikrein gene promoter (hgt-1). Exemplary tissue-specific promoters for gastric tissue include H+/K+-ATPase alpha subunit promoter. Exemplary tissue-specific expression elements for the pancreas include pancreatitis associated protein promoter (PAP), elastase 1 transcriptional enhancer, pancreas specific amylase and elastase enhancer promoter, and pancreatic cholesterol esterase gene promoter. Exemplary tissue-specific promoters for the endometrium include, the uteroglobin promoter. Exemplary tissue-specific promoters for adrenal cells include cholesterol side-chain cleavage (SCC) promoter. Exemplary tissue-specific promoters for the general nervous system include gamma-gamma enolase (neuron-specific enolase, NSE) promoter. Exemplary tissue-specific promoters for the brain include the neurofilament heavy chain (NF-H) promoter. Exemplary tissue-specific promoters for lymphocytes include the human CGL-1/granzyme B promoter, the terminal deoxy transferase (TdT), lambda 5, VpreB, and lck (lymphocyte specific tyrosine protein kinase p56lck) promoter, the humans CD2 promoter and its 3'transcriptional enhancer, and the human NK and T cell specific activation (NKG5) promoter. Exemplary tissue-specific promoters for the colon include pp60c-src tyrosine kinase promoter, organ-specific neoantigens (OSNs) promoter, and colon specific antigen-P promoter. Exemplary tissue-specific promoters for breast cells include the human alpha-lactalbumin promoter. Exemplary tissue-specific promoters for the lung include the cystic fibrosis transmembrane conductance regulator (CFTR) gene promoter.

Examples of cell-specific, tissue-specific, or organ-specific promoters may also include those used for expressing the barcode or other transcripts within a particular plant tissue (See e.g., WO2001098480A2, "Promoters for regulation of plant gene expression"). Examples of such promoters include the lectin (Vodkin, Prog. Clinc. Biol. Res., 138:87-98 (1983); and Lindstrom et al., Dev. Genet., 11:160-167 (1990)), corn alcohol dehydrogenase 1 (Dennis et al., Nucleic Acids Res., 12:3983-4000 (1984)), corn light harvesting complex (Becker, Plant Mol Biol., 20(1): 49-60 (1992); and Bansal et al., Proc. Natl. Acad. Sci. U.S.A., 89:3654-3658 (1992)), corn heat shock protein (Odell et al., Nature (1985) 313:810-812; and Marrs et al., Dev. Genet., 14(1):27-41 (1993)), small subunit RuBP carboxylase (Waksman et al., Nucleic Acids Res., 15(17):7181 (1987); and Berry-Lowe et al., J. Mol. Appl. Genet., 1(6):483-498 (1982)), Ti plasmid mannopine synthase (Ni et al., Plant Mol. Biol., 30(1):77-96 (1996)), Ti plasmid nopaline synthase (Bevan, Nucleic Acids Res., 11(2):369-385 (1983)), *petunia* chalcone isomerase (Van Tunen et al., EMBO J., 7:1257-1263 (1988)), bean glycine rich protein 1 (Keller et al., Genes Dev., 3:1639-1646 (1989)), truncated CaMV 35s (Odell et al., Nature (1985) 313:810-812), potato patatin (Wenzler et al., Plant Mol. Biol., 13:347-354 (1989)), root cell (Yamamoto et al., Nucleic Acids Res., 18:7449 (1990)), maize zein (Reina et al., Nucleic Acids Res., 18:6425 (1990); Kriz et al., Mol. Gen. Genet., 207:90-98 1987; Wandelt and Feix, Nucleic Acids Res., 17:2354 (1989); Langridge and Feix, Cell, 34:1015-1022 (1983); and Reina et al., Nucleic Acids Res., 18:7449 (1990)), globulin-1 (Belanger et al., Genetics, 129:863-872 (1991)), α-tubulin, cab (Sullivan et al., Mol. Gen. Genet., 215:431-440 (1989)), PEPCase (Cushman et al., Plant Cell, 1(7):715-25 (1989)), R gene complex-associated promoters (Chandler et al., Plant Cell, 1: 1175-1183 (1989)), and chalcone synthase promoters (Franken et al., EMBO J., 10:2605-2612, 1991)). Examples of tissue-specific promoters also include those described in the following references: Yamamoto et al., Plant J (1997) 12(2):255-265; Kawamata et al., Plant Cell Physiol. (1997) 38(7):792-803; Hansen et al., Mol. Gen Genet. (1997) 254(3):337); Russell et al., Transgenic Res. (1997) 6(2):157-168; Rinehart et al., Plant Physiol. (1996) 112(3):1331; Van Camp et al., Plant Physiol. (1996) 112(2): 525-535; Canevascini et al., Plant Physiol. (1996) 112(2): 513-524; Yamamoto et al., Plant Cell Pkysiol. (1994) 35(5): 773-778; Lam, Results Probl. Cell Differ. (1994) 20:181-196; Orozco et al., Plant Mol. Biol. (1993) 23(6):1129-1138; Matsuoka et al., Proc Natl. Acad. Sci. USA (1993) 90(20): 9586-9590; and Guevara-Garcia et al., Plant J. (1993) 4(3): 495-505; maize phosphoenol carboxylase (PEPC) has been described by Hudspeth & Grula (Plant Molec Biol 12: 579-589 (1989)); leaf-specific promoters such as those described in Yamamoto et al., Plant J. (1997) 12(2):255-265; Kwon et al., Plant Physiol. (1994) 105:357-367; Yamamoto

Nuclear Localization Signals

In some embodiments, the systems and compositions herein further comprise one or more nuclear localization signals (NLSs) capable of driving the accumulation of the components, e.g., Cas and/or transposase(s) to a desired amount in the nucleus of a cell.

In certain embodiments, at least one nuclear localization signal (NLS) is attached to the Cas and/or transposase(s), or polynucleotides encoding the proteins. In some embodiments, one or more C-terminal or N-terminal NLSs are attached (and hence nucleic acid molecule(s) coding for the Cas and/or transposase(s)can include coding for NLS(s) so that the expressed product has the NLS(s) attached or connected). In an embodiment a C-terminal NLS is attached for expression and nuclear targeting in eukaryotic cells, e.g., human cells.

Non-limiting examples of NLSs include an NLS sequence derived from: the NLS of the SV40 virus large T-antigen, having the amino acid sequence PKKKRKV (SEQ ID NO:417); the NLS from nucleoplasmin (e.g., the nucleoplasmin bipartite NLS with the sequence KRPAATKK-AGQAKKK (SEQ ID NO:418)); the c-myc NLS having the amino acid sequence PAAKRVKLD (SEQ ID NO:419) or RQRRNELKRS (SEQ ID NO:420); the hRNPA1 M9 NLS having the sequence NQSSNFGPMKGGNFG-GRSSGPYGGGGQYFAKPRNQGGY (SEQ ID NO:421); the sequence RMRIZFKNKGKDTAELRRRRVEVS-VELRKAKKDEQILKRRNV (SEQ ID NO:422) of the IBB domain from importin-alpha; the sequences VSRKRPRP (SEQ ID NO:423) and PPKKARED (SEQ ID NO:424) of the myoma T protein; the sequence PQPKKKPL (SEQ ID NO:425) of human p53; the sequence SALIKKKKKMAP (SEQ ID NO:426) of mouse c-abl IV; the sequences DRLRR (SEQ ID NO:427) and PKQKKRK (SEQ ID NO:428) of the influenza virus NS1; the sequence RKLKKKIKKL (SEQ ID NO:429) of the Hepatitis virus delta antigen; the sequence REKKKFLKRR (SEQ ID NO:430) of the mouse Mx1 protein; the sequence KRKGDEVDGVDEVAKKKSKK (SEQ ID NO:431) of the human poly(ADP-ribose) polymerase; and the sequence RKCLQAGMNLEARKTKK (SEQ ID NO:432) of the steroid hormone receptors (human) glucocorticoid.

In some embodiments, a NLS is a heterologous NLS. For example, the NLS is not naturally present in the molecule (e.g., Cas and/or transposase(s)) it attached to.

In general, strength of nuclear localization activity may derive from the number of NLSs in the nucleic acid-targeting effector protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI).

In some embodiments, a vector described herein (e.g., those comprising polynucleotides encoding Cas and/or transposase(s)) comprise one or more nuclear localization sequences (NLSs), such as about or more than about 1, 2, 3, 4, 5, 6, 7, 8, 9, 10, or more NLSs. More particularly, vector comprises one or more NLSs not naturally present in the Cas and/or transposase(s). Most particularly, the NLS is present in the vector 5' and/or 3' of the Cas and/or transposase(s) sequence. In some embodiments, the Cas and/or transposase(s) comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus.

In certain embodiments, other localization tags may be fused to the Cas and/or transposase(s), such as without limitation for localizing to particular sites in a cell, such as to organelles, such as mitochondria, plastids, chloroplasts, vesicles, golgi, (nuclear or cellular) membranes, ribosomes, nucleolus, ER, cytoskeletons, vacuoles, centrosomes, nucleosome, granules, centrioles, etc. In certain example embodiments, one or more NLS are attached to the Cas protein, a TnsB proteins, a TnsC protein, a TniQ protein, or a combination thereof.

Methods of Inserting Donor Polynucleotides

The present disclosure further provides methods of inserting a donor polynucleotide into a target nucleic acid in a cell, which comprises introducing into a cell: (a) one or more transposases (e.g., CRISPR-associated transposases) or functional fragments thereof, (b) one or more nucleotide-binding molecules. The one or more nucleotide-binding molecules may be sequence-specific.

In one example embodiment, the method comprises introducing into a cell or a population of cells, (a) one or more CRISPR-associated transposases or functional fragments thereof, (b) a Cas protein, (c) a guide molecule capable of binding to a target sequent on a target polynucleotide, and designed to form a CRISPR-Cas complex with the Cas protein, and (d) a donor polynucleotide comprising the polynucleotide sequence to be introduced.

The one or more of components (a)-(d) may be introduced into a cell by delivering a delivery polynucleotide comprising nucleic acid sequence encoding the one or more components. The nucleic acid sequence encoding the one or more components may be expressed from a nucleic acid operably linked to a regulatory sequence that is expressed in the cell. The one or more components may be encoded on the same delivery polynucleotide, on individual delivery polynucleotides, or some combination thereof. The delivery polynucleotide may be a vector. Example vectors and delivery compositions are discussed in further detail below.

Alternatively, the components (a)-(d) may be delivered to a cell or population of cells as a pre-formed ribonucleoprotein (RNP) complex. In certain example embodiments, components (a)-(c) are delivered s an RNP and component (d) is delivered as a polynucleotide. Suitable example compositions for delivery of RNPs are discussed in further detail below.

In certain example embodiments, the CAST system described above is delivered to prokaryotic cell. In certain example embodiments, the cell is a eukaryotic cell. The eukaryotic cell may be a mammalian cell, a cell of a non-human primate, or a human cell. In certain example embodiments, the cell may be a plant cell.

In certain example embodiments, the CAST system may be delivered to a cell or population of cells in vitro.

In certain example embodiments, the CAST system may be delivered in vivo.

The insertion may occur at a position from a Cas binding site on a nucleic acid molecule. In some examples, the insertion may occur at a position on the 3' side from a Cas binding site, e.g., at least 1 bp, at least 5 bp, at least 10 bp, at least 15 bp, at least 20 bp, at least 35 bp, at least 40 bp, at least 45 bp, at least 50 bp, at least 55 bp, at least 60 bp, at least 65 bp, at least 70 bp, at least 75 bp, at least 80 bp, at least 85 bp, at least 90 bp, at least 95 bp, or at least 100 bp on the 3' side from a Cas binding site. In some examples, the insertion may occur at a position on the 5' side from a Cas binding site, e.g., at least 1 bp, at least 5 bp, at least 10 bp, at least 15 bp, at least 20 bp, at least 35 bp, at least 40 bp, at least 45 bp, at least 50 bp, at least 55 bp, at least 60 bp, at least 65 bp, at least 70 bp, at least 75 bp, at least 80 bp, at least 85 bp, at least 90 bp, at least 95 bp, or at least 100 bp on the 5' side from a Cas binding site. In a particular example, the insertion may occur 65 bp on the 3' side from the Cas binding site.

In some cases, the donor polynucleotide is inserted to the target polynucleotide via a cointegrate mechanism. For example, the donor polynucleotide and the target polynucleotide may be nicked and fused. A duplicate of the fused donor polynucleotide and the target polynucleotide may be generated by a polymerase. In certain cases, the donor polynucleotide is inserted in the target polynucleotide via a cut and paste mechanism. For example, the donor polynucleotide may be comprised in a nucleic acid molecule and may be cut out and inserted to another position in the nucleic acid molecule.

Delivery and Administration

Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994).

RNA Delivery

In some embodiments, it is envisaged to introduce the RNA and/or protein directly to the host cell. For instance, the CRISPR effector can be delivered as CRISPR effector-encoding mRNA together with an in vitro transcribed guide RNA. Such methods can reduce the time to ensure effect of the CRISPR effector protein and further prevents long-term expression of the components of the systems.

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™) Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

Plasmid delivery involves the cloning of a guide RNA into a CRISPR effector protein expressing plasmid and transfecting the DNA in cell culture. Plasmid backbones are available commercially and no specific equipment is required. They have the advantage of being modular, capable of carrying different sizes of CRISPR effector coding sequences (including those encoding larger sized proteins) as well as selection markers. Both an advantage of plasmids is that they can ensure transient, but sustain expression. However, delivery of plasmids is not straightforward such that in vivo efficiency is often low. The sustained expression can also be disadvantageous in that it can increase off-target editing. In addition excess build-up of the CRISPR effector protein can be toxic to the cells. Finally, plasmids always hold the risk of random integration of the dsDNA in the host genome, more particularly in view of the double-stranded breaks being generated (on and off-target). The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787). This is discussed more in detail below.

In particular embodiments, RNA based delivery is used. In these embodiments, mRNA of the CRISPR effector protein is delivered together with in vitro transcribed guide RNA. Liang et al. describes efficient genome editing using RNA based delivery (Protein Cell. 2015 May; 6(5): 363-372).

RNA delivery: The CRISPR enzyme, for instance a Type V effector, transposase and/or any of the present RNAs, for instance a guide RNA, can also be delivered in the form of RNA. Type V effector and transposase mRNA can be generated using in vitro transcription. For example, Type V effector mRNA can be synthesized using a PCR cassette containing the following elements: T7_promoter-kozak sequence (GCCACC)-Type V effector-3' UTR from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce possible toxicity, the CRISPR enzyme-coding sequence and/or the guide RNA can be modified to include one or more modified nucleoside e.g. using pseudo-U or 5-Methyl-C.

mRNA delivery methods are especially promising for liver delivery currently.

Much clinical work on RNA delivery has focused on RNAi or antisense, but these systems can be adapted for delivery of RNA for implementing the present invention. References below to RNAi etc. should be read accordingly.

The system mRNA and guide RNA might also be delivered separately. The mRNA can be delivered prior to the guide RNA to give time for the CRISPR enzyme to be expressed. The system mRNA might be administered 1-12 hours (preferably around 2-6 hours) prior to the administration of guide RNA.

Alternatively, the mRNA and guide RNA can be administered together. Advantageously, a second booster dose of guide RNA can be administered 1-12 hours (preferably around 2-6 hours) after the initial administration of mRNA+ guide RNA.

Indeed, RNA delivery is a useful method of in vivo delivery. It is possible to deliver Type V effector and gRNA (and, for instance, HR repair template) into cells using liposomes or particles. Thus delivery of the CRISPR enzyme, such as a Type V effector and/or delivery of the RNAs of the invention may be in RNA form and via microvesicles, liposomes or particles. For example, Type V effector mRNA and gRNA can be packaged into liposomal particles for delivery in vivo. Liposomal transfection reagents such as lipofectamine from Life Technologies and other reagents on the market can effectively deliver RNA molecules into the liver.

Liposomes

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Particle Delivery

Means of delivery of RNA also include delivery of RNA via particles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purified and characterized from transfected cell supernatant, then RNA is loaded into the exosomes. Delivery or administration according to the invention can be performed with exosomes, in particular but not limited to the brain. Vitamin E (α-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, Calif.) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to α-tocopherol and co-administered with HDL targeted to the brain may be contemplated for humans in the present invention, for example, about 3 nmol to about 3 μmol of CRISPR Cas targeted to the brain may be contemplated. Zou et al. ((HUMAN GENE THERAPY 22:465-475 (April 2011)) describe a method of lentiviral-mediated delivery of short-hairpin RNAs targeting PKCγ for in vivo gene silencing in the spinal cord of rats. Zou et al. administered about 10 of a recombinant lentivirus having a titer of $1 \times 10^9$ transducing units (TU)/ml by an intrathecal catheter. A similar dosage of CRISPR Cas expressed in a lentiviral vector targeted to the brain may be contemplated for humans in the present invention, for example, about 10-50 ml of CRISPR Cas targeted to the brain in a lentivirus having a titer of $1 \times 10^9$ transducing units (TU)/ml may be contemplated.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purified and characterized from transfected cell supernatant, then RNA is loaded into the exosomes. Delivery or administration according to the invention can be performed with exosomes, in particular but not limited to the brain. Vitamin E (α-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, Calif.) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to α-tocopherol and co-administered with HDL targeted to the brain may be contemplated for humans in the present invention, for example, about 3 nmol to about 3 μmol of CRISPR Cas targeted to the brain may be contemplated.

Anderson et al. (US 20170079916) provides a modified dendrimer nanoparticle for the delivery of therapeutic, prophylactic and/or diagnostic agents to a subject, comprising: one or more zero to seven generation alkylated dendrimers; one or more amphiphilic polymers; and one or more therapeutic, prophylactic and/or diagnostic agents encapsulated therein. One alkylated dendrimer may be selected from the group consisting of poly(ethyleneimine), poly(polyproylenimine), diaminobutane amine polypropylenimine tetramine and poly(amido amine). The therapeutic, prophylactic and diagnostic agent may be selected from the group consisting of proteins, peptides, carbohydrates, nucleic acids, lipids, small molecules and combinations thereof.

Anderson et al. (US 20160367686) provides a compound of Formula (I):

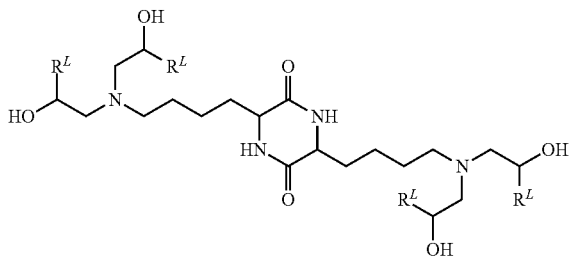

(I)

and salts thereof, wherein each instance of R L is independently optionally substituted C6-C40 alkenyl, and a composition for the delivery of an agent to a subject or cell comprising the compound, or a salt thereof; an agent; and optionally, an excipient. The agent may be an organic molecule, inorganic molecule, nucleic acid, protein, peptide, polynucleotide, targeting agent, an isotopically labeled chemical compound, vaccine, an immunological agent, or an agent useful in bioprocessing. The composition may further comprise cholesterol, a PEGylated lipid, a phospholipid, or an apolipoprotein.

Anderson et al. (US20150232883) provides delivery particle formulations and/or systems, preferably nanoparticle delivery formulations and/or systems, comprising (a) a CRISPR-Cas system RNA polynucleotide sequence; or (b) Cas9; or (c) both a CRISPR-Cas system RNA polynucleotide sequence and Cas9; or (d) one or more vectors that contain nucleic acid molecule(s) encoding (a), (b) or (c), wherein the CRISPR-Cas system RNA polynucleotide sequence and the Cas9 do not naturally occur together. The delivery particle formulations may further comprise a surfactant, lipid or protein, wherein the surfactant may comprise a cationic lipid.

Anderson et al. (US20050123596) provides examples of microparticles that are designed to release their payload when exposed to acidic conditions, wherein the microparticles comprise at least one agent to be delivered, a pH triggering agent, and a polymer, wherein the polymer is selected from the group of polymethacrylates and polyacrylates.

Anderson et al (US 20020150626) provides lipid-protein-sugar particles for delivery of nucleic acids, wherein the polynucleotide is encapsulated in a lipid-protein-sugar matrix by contacting the polynucleotide with a lipid, a protein, and a sugar; and spray drying mixture of the polynucleotide, the lipid, the protein, and the sugar to make microparticles.

In terms of local delivery to the brain, this can be achieved in various ways. For instance, material can be delivered intrastriatally e.g. by injection. Injection can be performed stereotactically via a craniotomy.

Enhancing NHEJ or HR efficiency is also helpful for delivery. It is preferred that NHEJ efficiency is enhanced by co-expressing end-processing enzymes such as Trex2 (Dumitrache et al. Genetics. 2011 August; 188(4): 787-797). It is preferred that HR efficiency is increased by transiently inhibiting NHEJ machineries such as Ku70 and Ku86. HR efficiency can also be increased by co-expressing prokaryotic or eukaryotic homologous recombination enzymes such as RecBCD, RecA.

Vectors

In certain aspects the invention involves vectors, e.g. for delivering or introducing in a cell Cas and/or RNA capable of guiding Cas to a target locus (i.e. guide RNA), but also for propagating these components (e.g. in prokaryotic cells). As used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids. In some embodiments, a host cell is transiently or non-transiently transfected with one or more vectors described herein. In some embodiments, a cell is transfected as it naturally occurs in a subject optionally to be reintroduced therein. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rath, CV1, RPTE, A10, T24, J82, A375, ARH-77, Calul, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRCS, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO—IR, CHO-K1, CHO-K2, CHO-T, CHO Dhfr-/-, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1cic7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety. Thus, the embodiments disclosed herein may also comprise transgenic cells comprising the CRISPR effector system. In certain example embodiments, the transgenic cell may function as an individual discrete volume. In other words samples comprising a masking construct may be delivered to a cell, for example in a suitable delivery vesicle and if the target is present in the delivery vesicle the CRISPR effector is activated and a detectable signal generated.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-18, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (genome-engineering.org/taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxfordjournals.org/content/34/7/e53. short and nature.com/mt/journal/v16/n9/abs/mt2008144a.html). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters—especially as to the numbers of RNAs or guides discussed herein, without any undue experimentation.

Vector delivery, e.g., plasmid, viral delivery: The CRISPR enzyme, for instance a Type V-U5 effector, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Type V-U5 effector and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Among vectors that may be used in the practice of the invention, integration in the host genome of a cell is possible with retrovirus gene transfer methods, often resulting in long term expression of the inserted transgene. In a preferred embodiment the retrovirus is a lentivirus. Additionally, high transduction efficiencies have been observed in many different cell types and target tissues. The tropism of a retrovirus can be altered by incorporating foreign envelope proteins, expanding the potential population of target cells. A retrovirus can also be engineered to allow for conditional expression of the inserted transgene, such that only certain cell types are infected by the lentivirus. Cell type specific promoters can be used to target expression in specific cell types. Lentiviral vectors are retroviral vectors (and hence both lentiviral and retroviral vectors may be used in the practice of the invention). Moreover, lentiviral vectors are preferred as they are able to transduce or infect non-dividing cells and typically produce high viral titers. Selection of a retroviral gene transfer system may therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the desired nucleic acid into the target cell to provide permanent expression. Widely used retroviral vectors that may be used in the practice of the invention include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., (1992) J. Virol. 66:2731-2739; Johann et al., (1992) J. Virol. 66:1635-1640; Sommnerfelt et al., (1990) Virol. 176:58-59; Wilson et al., (1998) J. Virol. 63:2374-2378; Miller et al., (1991) J. Virol. 65:2220-2224; PCT/US94/05700). Zou et al. administered about 10 µl of a recombinant lentivirus having a titer of $1 \times 10^9$ transducing units (TU)/ml by an intrathecal catheter. These sort of dosages can be adapted or extrapolated to use of a retroviral or lentiviral vector in the present invention.

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

Vector Packaging of CRISPR Proteins

Ways to package inventive Type V coding nucleic acid molecules, e.g., DNA, into vectors, e.g., viral vectors, to mediate genome modification in vivo include:

To achieve NHEJ-mediated gene knockout:
Single virus vector:
Vector containing two or more expression cassettes:
Promoter-Type V effector-coding nucleic acid molecule-terminator
Promoter-gRNA1-terminator
Promoter-gRNA2-terminator
Promoter-gRNA(N)-terminator (up to size limit of vector)
Double virus vector:
Vector 1 containing one expression cassette for driving the expression of the Type V effector
Promoter-Type V effector-coding nucleic acid molecule-terminator
Vector 2 containing one more expression cassettes for driving the expression of one or more guide RNAs
Promoter-gRNA1-terminator
Promoter-gRNA(N)-terminator (up to size limit of vector)
To mediate homology-directed repair.
In addition to the single and double virus vector approaches described above, an additional vector can be used to deliver a homology-direct repair template.
The promoter used to drive Type V effector coding nucleic acid molecule expression can include: AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of a Type V effector. For ubiquitous expression, promoters that can be used include: CMV, CAG, CBh, PGK, SV40, Ferritin heavy or light chains, etc.

For brain or other CNS expression, can use promoters: SynapsinI for all neurons, CaMKIIalpha for excitatory neurons, GAD67 or GAD65 or VGAT for GABAergic neurons, etc.

For liver expression, can use Albumin promoter.
For lung expression, can use SP-B.
For endothelial cells, can use ICAM.
For hematopoietic cells can use IFNbeta or CD45.
For Osteoblasts can one can use the OG-2.

The promoter used to drive guide RNA can include: Pol III promoters such as U6 or H1; Use of Pol II promoter and intronic cassettes to express gRNA.

Identifying Appropriate Delivery Vector

In some embodiments, the components of the System may be delivered in various form, such as combinations of DNA/RNA or RNA/RNA or protein/RNA. For example, the Type V-U5 effector may be delivered as a DNA-coding polynucleotide or an RNA—coding polynucleotide or as a protein. The guide may be delivered as a DNA-coding polynucleotide or an RNA. All possible combinations are envisioned, including mixed forms of delivery.

In some aspects, the invention provides methods comprising delivering one or more polynucleotides, such as or one or more vectors as described herein, one or more transcripts thereof, and/or one or proteins transcribed therefrom, to a host cell.

Adeno Associated Virus (AAV)

Type V effector and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g. a male adult human), and can be adjusted for patients, subjects, and mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of a Type V effector can be driven by a cell-type specific promoter. For example, liver-specific expression might use the Albumin promoter and neuron-specific expression (e.g. for targeting CNS disorders) might use the Synapsin I promoter.

The invention provides AAV that contains or consists essentially of an exogenous nucleic acid molecule encoding a system, e.g., a plurality of cassettes comprising or consisting a first cassette comprising or consisting essentially of a promoter, a nucleic acid molecule encoding a CRISPR-associated (Cas) protein (putative nuclease or helicase proteins), e.g., Cas9 and a terminator, and a two, or more, advantageously up to the packaging size limit of the vector, e.g., in total (including the first cassette) five, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator Promoter-gRNA(N)-terminator (where N is a number that can be inserted that is at an upper limit of the packaging size limit of the vector), or two or more individual rAAVs, each containing one or more than one cassette of a system, e.g., a first rAAV containing the first cassette comprising or consisting essentially of a promoter, a nucleic acid molecule encoding Cas, e.g., Cas9 and a terminator, and a second rAAV containing a plurality, four, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA (N)-terminator (where N is a number that can be inserted that is at an upper limit of the packaging size limit of the vector). As rAAV is a DNA virus, the nucleic acid molecules in the herein discussion concerning AAV or rAAV are advantageously DNA. The promoter is in some embodiments advantageously human Synapsin I promoter (hSyn). In another embodiment, multiple gRNA expression cassettes along with the Cas9 expression cassette can be delivered in a high-capacity adenoviral vector (HCAdV), from which all AAV coding genes have been removed. See e.g, Schiwon et al., "One-Vector System for Multiplexed CRISPR/Cas9 against Hepatitis B Virus cccDNA Utilizing High-Capacity Adenoviral Vectors" Mol Ther Nucleic Acids. 2018 Sep. 7; 12: 242-253; and Ehrke-Schulz et al., "CRISPR/Cas9 delivery with one single adenoviral vector devoid of all viral genes" Sci Rep. 2017; 7: 17113. Additional methods for the delivery of nucleic acids to cells are known to those skilled in the art. See, for example, US20030087817, incorporated herein by reference.

In some embodiments, an AAV vector can include additional sequence information encoding sequences that facilitate transduction or that assist in evasion of the host immune system. In one embodiment, CRISPR-Cas9 can be delivered to astrocytes using an AAV vector that includes a synthetic surface peptide for transduction of astrocytes. See, e.g. Kunze et al., "Synthetic AAV/CRISPR vectors for blocking HIV-1 expression in persistently infected astrocytes" Glia. 2018 aFebruary; 66(2):413-427. In another embodiment, CRISPR-Cas9 can be delivered in a capsid engineered AAV, for example an AAV that has been engineered to include "chemical handles" on the AAV surface and be complexed with lipids to produce a "cloaked AAV" that is resistant to endogenous neutralizing antibodies in the host. See, e.g. Katrekar et al., "Oligonucleotide conjugated multi-functional adeno-associated viruses" Sci Rep. 2018; 8: 3589.

Also contemplated is delivery by dual vector systems. In one embodiment, expression cassettes of Cas9 and gRNA can be delivered via a dual vector system. Such systems can include, for example, a first AAV vector encoding a gRNA and an N-terminal Cas9 and a second AAV vector containing a C-terminal Cas9. See, e.g. Moreno et al., "In Situ Gene Therapy via AAV—CRISPR-Cas9-Mediated Targeted Gene Regulation" Mol Ther. 2018 Jul. 5; 26(7):1818-1827. In another embodiment, Cas9 protein can be separated into two parts that are expressed individually and reunited in the cell by various means, including use of 1) the gRNA as a scaffold for Cas9 assembly; 2) the rapamycin-controlled FKBP/FRB system; 3) the light-regulated Magnet system; or 4) inteins. See, e.g. Schmelas et al., "Split Cas9, Not Hairs—Advancing the Therapeutic Index of CRISPR Technology" Biotechnol J. 2018 September; 13(9):e1700432. doi: 10.1002/biot.201700432. Epub 2018 Feb. 2.

In terms of in vivo delivery, AAV is advantageous over other viral vectors for a couple of reasons: low toxicity (this may be due to the purification method not requiring ultra centrifugation of cell particles that can activate the immune response) and low probability of causing insertional mutagenesis because it does not integrate into the host genome.

AAV has a packaging limit of 4.5 or 4.75 Kb. This means that a Type V effector as well as a promoter and transcription terminator have to all fit into the same viral vector. Constructs larger than 4.5 or 4.75 Kb will lead to significantly reduced virus production.

rAAV vectors are preferably produced in insect cells, e.g., *Spodoptera frugiperda* 519 insect cells, grown in serum-free suspension culture. Serum-free insect cells can be purchased from commercial vendors, e.g., Sigma Aldrich (EX-CELL 405).

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4C. They were then aliquoted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the system of the present invention. A minimum of 2.5×106 CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin,Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015.

Other Viral Vectors

In another embodiment, Cocal vesiculovirus envelope pseudotyped retroviral vector particles are contemplated (see, e.g., US Patent Publication No. 20120164118 assigned to the Fred Hutchinson Cancer Research Center). Cocal virus is in the Vesiculovirus genus, and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. Within certain aspects of these embodiments, the Gag, Pol, and accessory proteins are lentiviral and/or gammaretroviral.

Use of Minimal Promoters

The present application provides a vector for delivering an effector protein and at least one CRISPR guide RNA to a cell comprising a minimal promoter operably linked to a polynucleotide sequence encoding the effector protein and a second minimal promoter operably linked to a polynucleotide sequence encoding at least one guide RNA, wherein the length of the vector sequence comprising the minimal promoters and polynucleotide sequences is less than 4.4 Kb. In an embodiment, the vector is an AAV vector. In another embodiment, the effector protein is a Type V CRISPR enzyme. In a further embodiment, the protein is a c2c5 enzyme.

In a related aspect, the invention provides a lentiviral vector for delivering an effector protein and at least one CRISPR guide RNA to a cell comprising a promoter operably linked to a polynucleotide sequence encoding Type V effector and a second promoter operably linked to a polynucleotide sequence encoding at least one guide RNA, wherein the polynucleotide sequences are in reverse orientation.

In another aspect, the invention provides a method of expressing an effector protein and guide RNA in a cell comprising introducing the vector according any of the vector delivery systems disclosed herein. In an embodiment of the vector for delivering an effector protein, the minimal promoter is the Mecp2 promoter, tRNA promoter, or U6. In a further embodiment, the minimal promoter is tissue specific.

RNP

In particular embodiments, pre-complexed guide RNA, CRISPR-Cas protein, transposase, and donor polynucleotide are delivered as a ribonucleoprotein (RNP). RNPs have the advantage that they lead to rapid editing effects even more so than the RNA method because this process avoids the need for transcription. An important advantage is that both RNP delivery is transient, reducing off-target effects and toxicity issues.

In particular embodiments, the ribonucleoprotein is delivered by way of a polypeptide-based shuttle agent as described in WO2016161516. WO2016161516 describes efficient transduction of polypeptide cargos using synthetic peptides comprising an endosome leakage domain (ELD) operably linked to a cell penetrating domain (CPD), to a histidine-rich domain and a CPD. Similarly these polypeptides can be used for the delivery of CRISPR-effector based RNPs in eukaryotic cells.

In some embodiments, components of the systems herein (e.g., Cas, transposase(s), polynucleotides encoding thereof) may be produced in *E. coli*, purified, and assemble into an RNP in vitro (e.g., in a test tube).

Methods of proteins and nucleic acids delivering with RNP include those described in Kim et al. (2014, Genome Res. 24(6):1012-9); Paix et al. (2015, Genetics 204(1):47-54); Chu et al. (2016, BMC Biotechnol. 16:4), and Wang et al. (2013, Cell. 9; 153(4):910-8); Eickbush D G et al, Integration of *Bombyx mori* R2 sequences into the 28S ribosomal RNA genes of *Drosophila melanogaster*, Mol Cell Biol. 2000 January; 20(1):213-23; Mastroianni M et al., Group II intron-based gene targeting reactions in eukaryotes, PLoS One. 2008 Sep. 1; 3(9):e3121. doi: 10.1371/journal.pone.0003121; Thornton G B et al., Microinjection of vesicular stomatitis virus ribonucleoprotein into animal cells yields infectious virus, Biochem Biophys Res Commun. 1983 Nov. 15; 116(3):1160-7; Zuris J A et al., Cationic lipid-mediated delivery of proteins enables efficient protein-based genome editing in vitro and in vivo, Nat Biotechnol. 2015 January; 33(1):73-80. doi: 10.1038/nbt.3081; Weill C O et al., A practical approach for intracellular protein delivery, Cytotechnology. 2008 January; 56(1):41-8. doi: 10.1007/s10616-007-9102-3; Marschall A L et al., Targeting antibodies to the cytoplasm, MAbs. 2011 January-Feburary; 3(1):3-16.

Immune Orthogonal Orthologs

In some embodiments, when one or more components of the systems (e.g., transposases, nucleotide-binding molecules) herein need to be expressed or administered in a subject, immunogenicity of the components may be reduced by sequentially expressing or administering immune orthogonal orthologs of the components of the transposon complexes to the subject. As used herein, the term "immune orthogonal orthologs" refer to orthologous proteins that have similar or substantially the same function or activity, but have no or low cross-reactivity with the immune response generated by one another. In some embodiments, sequential expression or administration of such orthologs elicits low or no secondary immune response. The immune orthogonal orthologs can avoid being neutralized by antibodies (e.g., existing antibodies in the host before the orthologs are expressed or administered). Cells expressing the orthologs can avoid being cleared by the host's immune system (e.g., by activated CTLs). In some examples, CRISPR enzyme orthologs from different species may be immune orthogonal orthologs.

Immune orthogonal orthologs may be identified by analyzing the sequences, structures, and/or immunogenicity of a set of candidates orthologs. In an example method, a set of immune orthogonal orthologs may be identified by a) comparing the sequences of a set of candidate orthologs (e.g., orthologs from different species) to identify a subset of candidates that have low or no sequence similarity; and b) assessing immune overlap among the members of the subset of candidates to identify candidates that have no or low immune overlap. In some cases, immune overlap among candidates may be assessed by determining the binding (e.g., affinity) between a candidate ortholog and MHC (e.g., MHC type I and/or MHC II) of the host. Alternatively or additionally, immune overlap among candidates may be assessed by determining B-cell epitopes for the candidate orthologs. In one example, immune orthogonal orthologs may be identified using the method described in Moreno A M et al., BioRxiv, published online Jan. 10, 2018, doi: doi.org/10.1101/245985.

Aerosol Delivery

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector.

Hybrid Viral Capsid Delivery Systems

In one aspect, the invention provides a particle delivery system comprising a hybrid virus capsid protein or hybrid viral outer protein, wherein the hybrid virus capsid or outer protein comprises a virus capsid or outer protein attached to at least a portion of a non-capsid protein or peptide. The genetic material of a virus is stored within a viral structure called the capsid. The capsid of certain viruses are enclosed in a membrane called the viral envelope. The viral envelope is made up of a lipid bilayer embedded with viral proteins including viral glycoproteins. As used herein, an "envelope protein" or "outer protein" means a protein exposed at the surface of a viral particle that is not a capsid protein. For example envelope or outer proteins typically comprise proteins embedded in the envelope of the virus. Non-limiting examples of outer or envelope proteins include, without limitation, gp41 and gp120 of HIV, hemagglutinin, neuraminidase and M2 proteins of influenza virus.

In one example embodiment of the delivery system, the non-capsid protein or peptide has a molecular weight of up to a megadalton, or has a molecular weight in the range of 110 to 160 kDa, 160 to 200 kDa, 200 to 250 kDa, 250 to 300 kDa, 300 to 400 kDa, or 400 to 500 kDa, and the non-capsid protein or peptide comprises a CRISPR protein.

The present application provides a vector for delivering an effector protein and at least one CRISPR guide RNA to a cell comprising a minimal promoter operably linked to a polynucleotide sequence encoding the effector protein and a second minimal promoter operably linked to a polynucleotide sequence encoding at least one guide RNA, wherein the length of the vector sequence comprising the minimal promoters and polynucleotide sequences is less than 4.4 Kb. In an embodiment, the virus is an adeno-associated virus (AAV) or an adenovirus.

In a related aspect, the invention provides a lentiviral vector for delivering an effector protein and at least one CRISPR guide RNA to a cell comprising a promoter operably linked to a polynucleotide sequence encoding a Type V effector and a second promoter operably linked to a polynucleotide sequence encoding at least one guide RNA, wherein the polynucleotide sequences are in reverse orientation.

In an embodiment, the virus is lentivirus or murine leukemia virus (MuMLV). In an embodiment, the virus is an Adenoviridae or a Parvoviridae or a retrovirus or a Rhabdoviridae or an enveloped virus having a glycoprotein protein (G protein). In an embodiment, the virus is VSV or rabies virus. In an embodiment, the capsid or outer protein comprises a capsid protein having VP1, VP2 or VP3. In an embodiment, the capsid protein is VP3, and the non-capsid protein is inserted into or attached to VP3 loop 3 or loop 6.

In an embodiment, the virus is delivered to the interior of a cell. In an embodiment, the capsid or outer protein and the non-capsid protein can dissociate after delivery into a cell.

In an embodiment, the capsid or outer protein is attached to the protein by a linker. In an embodiment, the linker comprises amino acids. In an embodiment, the linker is a chemical linker. In an embodiment, the linker is cleavable. In an embodiment, the linker is biodegradable. In an embodiment, the linker comprises $(GGGGS)_{1-3}$, ENLYFQG, or a disulfide.

In an embodiment, the delivery system comprises a protease or nucleic acid molecule(s) encoding a protease that is expressed, said protease being capable of cleaving the linker, whereby there can be cleavage of the linker. In an embodiment of the invention, a protease is delivered with a particle component of the system, for example packaged, mixed with, or enclosed by lipid and or capsid. Entry of the particle into a cell is thereby accompanied or followed by cleavage and dissociation of payload from particle. In certain embodiments, an expressible nucleic acid encoding a protease is delivered, whereby at entry or following entry of the particle into a cell, there is protease expression, linker cleavage, and dissociation of payload from capsid. In certain embodiments, dissociation of payload occurs with viral replication. In certain embodiments, dissociation of payload occurs in the absence of productive virus replication.

In an embodiment, each terminus of a CRISPR protein is attached to the capsid or outer protein by a linker. In an embodiment, the non-capsid protein is attached to the exterior portion of the capsid or outer protein. In an embodiment, the non-capsid protein is attached to the interior portion of the capsid or outer protein. In an embodiment, the capsid or outer protein and the non-capsid protein are a fusion protein. In an embodiment, the non-capsid protein is encapsulated by the capsid or outer protein. In an embodiment, the non-capsid protein is attached to a component of the capsid protein or a component of the outer protein prior to formation of the capsid or the outer protein. In an embodiment, the protein is attached to the capsid or outer protein after formation of the capsid or outer protein.

In some embodiments a non-capsid protein or protein that is not a virus outer protein or a virus envelope (sometimes herein shorthanded as "non-capsid protein"), such as a CRISPR protein or portion thereof, can have one or more functional moiety(ies) thereon, such as a moiety for targeting or locating, such as an NLS or NES, or an activator or repressor.

In an embodiment of the system, a component or portion thereof can comprise a tag.

In an aspect, the invention provides a virus particle comprising a capsid or outer protein having one or more hybrid virus capsid or outer proteins comprising the virus capsid or outer protein attached to at least a portion of a non-capsid protein or a CRISPR protein.

In an aspect, the invention provides an in vitro method of delivery comprising contacting the system with a cell, optionally a eukaryotic cell, whereby there is delivery into the cell of constituents of the delivery system.

In an aspect, the invention provides an in vitro, a research or study method of delivery comprising contacting the system with a cell, optionally a eukaryotic cell, whereby there is delivery into the cell of constituents of the system, obtaining data or results from the contacting, and transmitting the data or results.

In an aspect, the invention provides a cell from or of an in vitro method of delivery, wherein the method comprises contacting the system with a cell, optionally a eukaryotic cell, whereby there is delivery into the cell of constituents of the system, and optionally obtaining data or results from the contacting, and transmitting the data or results.

In an aspect, the invention provides a cell from or of an in vitro method of delivery, wherein the method comprises contacting the system with a cell, optionally a eukaryotic cell, whereby there is delivery into the cell of constituents of the system, and optionally obtaining data or results from the contacting, and transmitting the data or results; and wherein the cell product is altered compared to the cell not contacted with the system, for example altered from that which would have been wild type of the cell but for the contacting.

In an embodiment, the cell product is non-human or animal.

In one embodiment, the particle delivery system comprises a virus particle adsorbed to a liposome or lipid particle or nanoparticle. In one embodiment, a virus is adsorbed to a liposome or lipid particle or nanoparticle either through electrostatic interactions, or is covalently linked through a linker. The lipid particle or nanoparticles (1 mg/ml) dissolved in either sodium acetate buffer (pH 5.2) or pure $H_2O$ (pH 7) are positively charged. The isoelectropoint of most viruses is in the range of 3.5-7. They have a negatively charged surface in either sodium acetate buffer (pH 5.2) or pure $H_2O$. The electrostatic interaction between the virus and the liposome or synthetic lipid nanoparticle is the most significant factor driving adsorption. By modifying the charge density of the lipid nanoparticle, e.g. inclusion of neutral lipids into the lipid nanoparticle, it is possible to modulate the interaction between the lipid nanoparticle and the virus, hence modulating the assembly. In one embodiment, the liposome comprises a cationic lipid.

In one aspect, the system may be delivered by one or more hybrid virus capsid proteins in combination with a lipid particle, wherein the hybrid virus capsid protein comprises at least a portion of a virus capsid protein attached to at least a portion of a non-capsid protein.

In one embodiment, the virus capsid protein of the delivery system is attached to a surface of the lipid particle. When the lipid particle is a bilayer, e.g., a liposome, the lipid particle comprises an exterior hydrophilic surface and an interior hydrophilic surface. In one embodiment, the virus capsid protein is attached to a surface of the lipid particle by an electrostatic interaction or by hydrophobic interaction.

In one embodiment, the particle delivery system has a diameter of 50-1000 nm, preferably 100-1000 nm.

In one embodiment, the delivery system comprises a non-capsid protein or peptide, wherein the non-capsid protein or peptide has a molecular weight of up to a megadalton. In one embodiment, the non-capsid protein or peptide has a molecular weight in the range of 110 to 160 kDa, 160 to 200 kDa, 200 to 250 kDa, 250 to 300 kDa, 300 to 400 kDa, or 400 to 500 kDa.

In one embodiment, the delivery system comprises a non-capsid protein or peptide, wherein the protein or peptide comprises a CRISPR protein or peptide.

In one embodiment, a weight ratio of hybrid capsid protein to wild-type capsid protein is from 1:10 to 1:1, for example, 1:1, 1:2, 1:3, 1:4, 1:5, 1:6, 1:7, 1:8, 1:9 and 1:10.

In one embodiment, the virus of the delivery system is an Adenoviridae or a Parvoviridae or a Rhabdoviridae or an enveloped virus having a glycoprotein protein. In one embodiment, the virus is an adeno-associated virus (AAV) or an adenovirus or a VSV or a rabies virus. In one embodiment, the virus is a retrovirus or a lentivirus. In one embodiment, the virus is murine leukemia virus (MuMLV).

In one embodiment, the virus capsid protein of the delivery system comprises VP1, VP2 or VP3.

In one embodiment, the virus capsid protein of the delivery system is VP3, and the non-capsid protein is inserted into or tethered or connected to VP3 loop 3 or loop 6.

In one embodiment, the virus of the delivery system is delivered to the interior of a cell.

In one embodiment, the virus capsid protein and the non-capsid protein are capable of dissociating after delivery into a cell.

In one aspect of the delivery system, the virus capsid protein is attached to the non-capsid protein by a linker. In one embodiment, the linker comprises amino acids. In one embodiment, the linker is a chemical linker. In another embodiment, the linker is cleavable or biodegradable. In one embodiment, the linker comprises $(GGGGS)_{1-3}$, ENLYFQG (SEQ ID NO:433), or a disulfide.

In one embodiment of the delivery system, each terminus of the non-capsid protein is attached to the capsid protein by a linker moiety.

In one embodiment, the non-capsid protein is attached to the exterior portion of the virus capsid protein. As used herein, "exterior portion" as it refers to a virus capsid protein means the outer surface of the virus capsid protein when it is in a formed virus capsid.

In one embodiment, the non-capsid protein is attached to the interior portion of the capsid protein or is encapsulated within the lipid particle. As used herein, "interior portion" as it refers to a virus capsid protein means the inner surface of the virus capsid protein when it is in a formed virus capsid. In one embodiment, the virus capsid protein and the non-capsid protein are a fusion protein.

In one embodiment, the fusion protein is attached to the surface of the lipid particle.

In one embodiment, the non-capsid protein is attached to the virus capsid protein prior to formation of the capsid.

In one embodiment, the non-capsid protein is attached to the virus capsid protein after formation of the capsid.

In one embodiment, the non-capsid protein comprises a targeting moiety.

In one embodiment, the targeting moiety comprises a receptor ligand.

In an embodiment, the non-capsid protein comprises a tag.

In an embodiment, the non-capsid protein comprises one or more heterologous nuclear localization signals(s) (NLSs).

In an embodiment, the protein or peptide comprises a Type II CRISPR protein or a Type V CRISPR protein.

In an embodiment, the delivery system further comprises guide RNS, optionally complexed with the CRISPR protein.

In an embodiment, the delivery system comprises a protease or nucleic acid molecule(s) encoding a protease that is expressed, whereby the protease cleaves the linker. In certain embodiments, there is protease expression, linker cleavage, and dissociation of payload from capsid in the absence of productive virus replication.

In an aspect, the invention provides a delivery system comprising a first hybrid virus capsid protein and a second hybrid virus capsid protein, wherein the first hybrid virus capsid protein comprises a virus capsid protein attached to a first part of a protein, and wherein the second hybrid virus capsid protein comprises a second virus capsid protein attached to a second part of the protein, wherein the first part of the protein and the second part of the protein are capable of associating to form a functional protein.

In an aspect, the invention provides a delivery system comprising a first hybrid virus capsid protein and a second hybrid virus capsid protein, wherein the first hybrid virus capsid protein comprises a virus capsid protein attached to a first part of a CRISPR protein, and wherein the second hybrid virus capsid protein comprises a second virus capsid protein attached to a second part of a CRISPR protein, wherein the first part of the CRISPR protein and the second part of the CRISPR protein are capable of associating to form a functional CRISPR protein.

In an embodiment of the delivery system, the first hybrid virus capsid protein and the second virus capsid protein are on the surface of the same virus particle.

In an embodiment of the delivery system, the first hybrid virus capsule protein is located at the interior of a first virus particle and the second hybrid virus capsid protein is located at the interior of a second virus particle.

In an embodiment of the delivery system, the first part of the protein or CRISPR protein is linked to a first member of a ligand pair, and the second part of the protein or CRISPR protein is linked to a second member of a ligand pair, wherein the first part of the ligand pair binds to the second part of the ligand pair in a cell. In an embodiment, the binding of the first part of the ligand pair to the second part of the ligand pair is inducible.

In an embodiment of the delivery system, either or both of the first part of the protein or CRISPR protein and the second part of the protein or CRISPR protein comprise one or more NLSs.

In an embodiment of the delivery system, either or both of the first part of the protein or CRISPR protein and the second part of the protein or CRISPR protein comprise one or more nuclear export signals (NESs).

In one aspect, the invention provides a delivery system for a non-naturally occurring or engineered system, component, protein or complex. The delivery system comprises a non-naturally occurring or engineered system, component, protein or complex, associated with a virus structural component and a lipid component. The delivery system can further comprise a targeting molecule, for example a targeting molecule that preferentially guides the delivery system to a cell type of interest, or a cell expressing a target protein of interest. The targeting molecule may be associated with or attached to the virus component or the lipid component. In certain embodiments, the virus component preferentially guides the delivery system to the target of interest.

In certain embodiments, the virus structural component comprises one or more capsid proteins including an entire capsid. In certain embodiments, such as wherein a viral capsid comprises multiple copies of different proteins, the delivery system can provide one or more of the same protein or a mixture of such proteins. For example, AAV comprises 3 capsid proteins, VP1, VP2, and VP3, thus delivery systems of the invention can comprise one or more of VP1, and/or one or more of VP2, and/or one or more of VP3. Accordingly, the present invention is applicable to a virus within the family Adenoviridae, such as Atadenovirus, e.g., Ovine atadenovirus D, Aviadenovirus, e.g., Fowl aviadenovirus A, Ichtadenovirus, e.g., Sturgeon ichtadenovirus A, Mastadenovirus (which includes adenoviruses such as all human adenoviruses), e.g., Human mastadenovirus C, and Siadenovirus, e.g., Frog siadenovirus A. Thus, a virus of within the family Adenoviridae is contemplated as within the invention with discussion herein as to adenovirus applicable to other family members. Target-specific AAV capsid variants can be used or selected. Non-limiting examples include capsid variants selected to bind to chronic myelogenous leukemia cells, human CD34 PBPC cells, breast cancer cells, cells of lung, heart, dermal fibroblasts, melanoma cells, stem cell, glioblastoma cells, coronary artery endothelial cells and keratinocytes. See, e.g., Buning et al, 2015, Current Opinion in Pharmacology 24, 94-104. From teachings herein and knowledge in the art as to modifications of adenovirus (see, e.g., U.S. Pat. Nos. 9,410,129, 7,344,872, 7,256,036, 6,911,199, 6,740,525; Matthews, "Capsid-Incorporation of Antigens into Adenovirus Capsid Proteins for a Vaccine Approach," Mol Pharm, 8(1): 3-11 (2011)), as well as regarding modifications of AAV, the skilled person can readily obtain a modified adenovirus that has a large payload protein or a CRISPR-protein, despite that heretofore it was not expected that such a large protein could be provided on an adenovirus. And as to the viruses related to adenovirus mentioned herein, as well as to the viruses related to AAV mentioned herein, the teachings herein as to modifying adenovirus and AAV, respectively, can be applied to those viruses without undue experimentation from this disclosure and the knowledge in the art.

In an embodiment of the invention, the delivery system comprises a virus protein or particle adsorbed to a lipid component, such as, for example, a liposome. In certain embodiments, a system, component, protein or complex is associated with the virus protein or particle. In certain embodiments, a system, component, protein or complex is associated with the lipid component. In certain embodiments, one system, component, protein or complex is associated with the virus protein or particle, and a second system, component, protein, or complex is associated with the lipid component. As used herein, associated with includes, but is not limited to, linked to, adhered to, adsorbed to, enclosed in, enclosed in or within, mixed with, and the like. In certain embodiments, the virus component and the lipid component are mixed, including but not limited to the virus component dissolved in or inserted in a lipid bilayer. In certain embodiments, the virus component and the lipid component are associated but separate, including but not limited a virus protein or particle adsorbed or adhered to a liposome. In embodiments of the invention that further comprise a targeting molecule, the targeting molecule can be associated with a virus component, a lipid component, or a virus component and a lipid component.

In another aspect, the invention provides a non-naturally occurring or engineered CRISPR protein associated with Adeno Associated Virus (AAV), e.g., an AAV comprising a CRISPR protein as a fusion, with or without a linker, to or with an AAV capsid protein such as VP1, VP2, and/or VP3; and, for shorthand purposes, such a non-naturally occurring or engineered CRISPR protein is herein termed a "AAV-CRISPR protein" More in particular, modifying the knowledge in the art, e.g., Rybniker et al., "Incorporation of Antigens into Viral Capsids Augments Immunogenicity of Adeno-Associated Virus Vector-Based Vaccines," J Virol. December 2012; 86(24): 13800-13804, Lux K, et al. 2005. Green fluorescent protein-tagged adeno-associated virus particles allow the study of cytosolic and nuclear trafficking. J. Virol. 79:11776-11787, Munch R C, et al. 2012. "Displaying high-affinity ligands on adeno-associated viral vectors enables tumor cell-specific and safe gene transfer." Mol. Ther. [Epub ahead of print.] doi:10.1038/mt.2012.186 and Warrington K H, Jr, et al. 2004. Adeno-associated virus type 2 VP2 capsid protein is nonessential and can tolerate large peptide insertions at its N terminus. J. Virol. 78:6595-6609, each incorporated herein by reference, one can obtain a modified AAV capsid of the invention. It will be understood by those skilled in the art that the modifications described herein if inserted into the AAV cap gene may result in modifications in the VP1, VP2 and/or VP3 capsid subunits. Alternatively, the capsid subunits can be expressed independently to achieve modification in only one or two of the capsid subunits (VP1, VP2, VP3, VP1+VP2, VP1+VP3, or VP2+VP3). One can modify the cap gene to have expressed at a desired location a non-capsid protein advantageously a large payload protein, such as a CRISPR-protein. Likewise, these can be fusions, with the protein, e.g., large payload protein such as a CRISPR-protein fused in a manner analogous to prior art fusions. See, e.g., US Patent Publication 20090215879; Nance et al., "Perspective on Adeno-Associated Virus Capsid Modification for Duchenne Muscular Dystrophy Gene Therapy," Hum Gene Ther. 26(12):786-800 (2015) and documents cited therein, incorporated herein by reference. The skilled person, from this disclosure and the knowledge in the art can make and use modified AAV or AAV capsid as in the herein invention, and through this disclosure one knows now that large payload proteins can be fused to the AAV capsid. Applicants provide AAV capsid-CRISPR protein (e.g., Cas, Cas9, dCas9, Cpf1, Cas13a, Cas13b) fusions and those AAV-capsid CRISPR protein (e.g., Cas, Cas9) fusions can be a recombinant AAV that contains nucleic acid molcule(s) encoding or providing CRISPR-Cas or system or complex RNA guide(s), whereby the CRISPR protein (e.g., Cas, Cas9) fusion delivers a system (e.g., by the fusion, e.g., VP1, VP2, pr VP3 fusion, and the guide RNA is provided by the coding of the recombinant virus, whereby in vivo, in a cell, the system is assembled from the nucleic acid molecule(s) of the recombinant providing the guide RNA and the outer surface of the virus providing the CRISPR-Enzyme or Cas or Cas9. Such as complex may herein be termed an "AAV-CRISPR system" or an "AAV—CRISPR-Cas" or "AAV-CRISPR complex" or AAV—CRISPR-Cas complex." Accordingly, the instant invention is also applicable to a virus in the genus Dependoparvovirus or in the family Parvoviridae, for instance, AAV, or a virus of Amdoparvovirus, e.g., Carnivore amdoparvovirus 1, a virus of Aveparvovirus, e.g., Galliform aveparvovirus 1, a virus of Bocaparvovirus, e.g., Ungulate bocaparvovirus 1, a virus of Copiparvovirus, e.g., Ungulate copiparvovirus 1, a virus of Dependoparvovirus, e.g., Adeno-associated dependoparvovirus A, a virus of Erythroparvovirus, e.g., Primate erythroparvovirus 1, a virus of Protoparvovirus, e.g., Rodent protoparvovirus 1, a virus of Tetraparvovirus, e.g., Primate tetraparvovirus 1. Thus, a virus of within the family Parvoviridae or the genus Dependoparvovirus or any of the other foregoing genera within Parvoviridae is contemplated as within the invention with discussion herein as to AAV applicable to such other viruses.

In one aspect, the invention provides a non-naturally occurring or engineered composition comprising a CRISPR enzyme which is part of or tethered to a AAV capsid domain, i.e., VP1, VP2, or VP3 domain of Adeno-Associated Virus (AAV) capsid. In some embodiments, part of or tethered to a AAV capsid domain includes associated with a AAV capsid domain. In some embodiments, the CRISPR enzyme may be fused to the AAV capsid domain. In some embodiments, the fusion may be to the N-terminal end of the AAV capsid domain. As such, in some embodiments, the C-terminal end of the CRISPR enzyme is fused to the N-terminal end of the AAV capsid domain. In some embodiments, an NLS and/or a linker (such as a GlySer linker) may be positioned between the C-terminal end of the CRISPR enzyme and the N-terminal end of the AAV capsid domain. In some embodiments, the fusion may be to the C-terminal end of the AAV capsid domain. In some embodiments, this is not preferred due to the fact that the VP1, VP2 and VP3 domains of AAV are alternative splices of the same RNA and so a C-terminal fusion may affect all three domains. In some embodiments, the AAV capsid domain is truncated. In some embodiments, some or all of the AAV capsid domain is removed. In some embodiments, some of the AAV capsid domain is removed and replaced with a linker (such as a GlySer linker), typically leaving the N-terminal and C-terminal ends of the AAV capsid domain intact, such as the first 2, 5 or 10 amino acids. In this way, the internal (non-terminal) portion of the VP3 domain may be replaced with a linker. It is particularly preferred that the linker is fused to the CRISPR protein. A branched linker may be used, with the CRISPR protein fused to the end of one of the braches. This allows for some degree of spatial separation between the capsid and the CRISPR protein. In this way, the CRISPR protein is part of (or fused to) the AAV capsid domain.

Alternatively, the CRISPR enzyme may be fused in frame within, i.e. internal to, the AAV capsid domain. Thus in some embodiments, the AAV capsid domain again preferably retains its N-terminal and C-terminal ends. In this case, a linker is preferred, in some embodiments, either at one or both ends of the CRISPR enzyme. In this way, the CRISPR enzyme is again part of (or fused to) the AAV capsid domain. In certain embodiments, the positioning of the CRISPR enzyme is such that the CRISPR enzyme is at the external surface of the viral capsid once formed. In one aspect, the invention provides a non-naturally occurring or engineered composition comprising a CRISPR enzyme associated with a AAV capsid domain of Adeno-Associated Virus (AAV) capsid. Here, associated may mean in some embodiments fused, or in some embodiments bound to, or in some embodiments tethered to. The CRISPR protein may, in some embodiments, be tethered to the VP1, VP2, or VP3 domain. This may be via a connector protein or tethering system such as the biotin-streptavidin system. In one example, a biotinylation sequence (15 amino acids) could therefore be fused to the CRISPR protein. When a fusion of the AAV capsid domain, especially the N-terminus of the AAV AAV capsid domain, with streptavidin is also provided, the two will therefore associate with very high affinity. Thus, in some embodiments, provided is a composition or system comprising a CRISPR protein-biotin fusion and a streptavidin-AAV capsid domain arrangement, such as a fusion. The CRISPR protein-biotin and streptavidin-AAV capsid domain forms a single complex when the two parts are brought together. NLSs may also be incorporated between the CRISPR protein and the biotin; and/or between the streptavidin and the AAV capsid domain.

An alternative tether may be to fuse or otherwise associate the AAV capsid domain to an adaptor protein which binds to or recognizes to a corresponding RNA sequence or motif. In some embodiments, the adaptor is or comprises a binding protein which recognizes and binds (or is bound by) an RNA sequence specific for said binding protein. In some embodiments, a preferred example is the MS2 (see Konermann et al. December 2014, cited infra, incorporated herein by reference) binding protein which recognizes and binds (or is bound by) an RNA sequence specific for the MS2 protein.

With the AAV capsid domain associated with the adaptor protein, the CRISPR protein may, in some embodiments, be tethered to the adaptor protein of the AAV capsid domain. The CRISPR protein may, in some embodiments, be tethered to the adaptor protein of the AAV capsid domain via the CRISPR enzyme being in a complex with a modified guide, see Konermann et al. The modified guide is, in some embodiments, a sgRNA. In some embodiments, the modified guide comprises a distinct RNA sequence; see, e.g., PCT/US14/70175, incorporated herein by reference.

In some embodiments, distinct RNA sequence is an aptamer. Thus, corresponding aptamer-adaptor protein systems are preferred. One or more functional domains may also be associated with the adaptor protein. An example of a preferred arrangement would be:

[AAV AAV capsid domain-adaptor protein]-[modified guide-CRISPR protein]

In certain embodiments, the positioning of the CRISPR protein is such that the CRISPR protein is at the internal surface of the viral capsid once formed. In one aspect, the invention provides a non-naturally occurring or engineered composition comprising a CRISPR protein associated with an internal surface of an AAV capsid domain. Here again, associated may mean in some embodiments fused, or in some embodiments bound to, or in some embodiments tethered to. The CRISPR protein may, in some embodiments, be tethered to the VP1, VP2, or VP3 domain such that it locates to the internal surface of the viral capsid once formed. This may be via a connector protein or tethering system such as the biotin-streptavidin system as described above.

When the CRISPR protein fusion is designed so as to position the CRISPR protein at the internal surface of the capsid once formed, the CRISPR protein will fill most or all of internal volume of the capsid. Alternatively the CRISPR protein may be modified or divided so as to occupy a less of the capsid internal volume. Accordingly, in certain embodiments, the invention provides a CRISPR protein divided in two portions, one portion comprises in one viral particle or capsid and the second portion comprised in a second viral particle or capsid. In certain embodiments, by splitting the CRISPR protein in two portions, space is made available to link one or more heterologous domains to one or both CRISPR protein portions.

Split CRISPR proteins are set forth herein and in documents incorporated herein by reference in further detail herein. In certain embodiments, each part of a split CRISPR proteins are attached to a member of a specific binding pair, and when bound with each other, the members of the specific binding pair maintain the parts of the CRISPR protein in proximity. In certain embodiments, each part of a split CRISPR protein is associated with an inducible binding pair. An inducible binding pair is one which is capable of being switched "on" or "off" by a protein or small molecule that binds to both members of the inducible binding pair. In general, according to the invention, CRISPR proteins may preferably split between domains, leaving domains intact. Preferred, non-limiting examples of such CRISPR proteins include, without limitation, Cas9, Cpf1, C2c2, Cas13a, Cas13b, and orthologues. Preferred, non-limiting examples of split points include, with reference to SpCas9: a split position between 202A/203S; a split position between 255F/256D; a split position between 310E/3111; a split position between 534R/535K; a split position between 572E/573C; a split position between 713S/714G; a split position between 1003L/104E; a split position between 1054G/1055E; a split position between 1114N/1115S; a split position between 1152K/1153S; a split position between 1245K/1246G; or a split between 1098 and 1099.

In some embodiments, any AAV serotype is preferred. In some embodiments, the VP2 domain associated with the CRISPR enzyme is an AAV serotype 2 VP2 domain. In some embodiments, the VP2 domain associated with the CRISPR enzyme is an AAV serotype 8 VP2 domain. The serotype can be a mixed serotype as is known in the art.

The CRISPR enzyme may form part of a CRISPR-Cas system, which further comprises a guide RNA (sgRNA) comprising a guide sequence capable of hybridizing to a target sequence in a genomic locus of interest in a cell. In some embodiments, the functional CRISPR-Cas system binds to the target sequence. In some embodiments, the functional CRISPR-Cas system may edit the genomic locus to alter gene expression. In some embodiments, the functional CRISPR-Cas system may comprise further functional domains.

In some embodiments, the CRISPR enzyme is a Cpf1. In some embodiments, the CRISPR enzyme is an FnCpf1. In some embodiments, the CRISPR enzyme is an AsCpf1, although other orthologs are envisaged. FnCpf1 and AsCpf1 are particularly preferred, in some embodiments.

In some embodiments, the CRISPR enzyme is external to the capsid or virus particle. In the sense that it is not inside the capsid (enveloped or encompassed with the capsid), but is externally exposed so that it can contact the target genomic DNA). In some embodiments, the CRISPR enzyme cleaves both strands of DNA to produce a double strand break (DSB). In some embodiments, the CRISPR enzyme is a nickase. In some embodiments, the CRISPR enzyme is a dual nickase. In some embodiments, the CRISPR enzyme is a deadCpf1. In some general embodiments, the CRISPR enzyme is associated with one or more functional domains. In some more specific embodiments, the CRISPR enzyme is a deadCpf1 and is associated with one or more functional domains. In some embodiments, the CRISPR enzyme comprises a Rec2 or HD2 truncation. In some embodiments, the CRISPR enzyme is associated with the AAV VP2 domain by way of a fusion protein. In some embodiments, the CRISPR enzyme is fused to Destabilization Domain (DD). In other words, the DD may be associated with the CRISPR enzyme by fusion with said CRISPR enzyme. The AAV can then, by way of nucleic acid molecule(s) deliver the stabilizing ligand (or such can be otherwise delivered) In some embodiments, the enzyme may be considered to be a modified CRISPR enzyme, wherein the CRISPR enzyme is fused to at least one destabilization domain (DD) and VP2. In some embodiments, the association may be considered to be a modification of the VP2 domain. Where reference is made herein to a modified VP2 domain, then this will be understood to include any association discussed herein of the VP2 domain and the CRISPR enzyme. In some embodiments, the AAV VP2 domain may be associated (or tethered) to the CRISPR enzyme via a connector protein, for example using a system such as the streptavidin-biotin system. As such, provided is a fusion of a CRISPR enzyme with a connector protein specific for a high affinity ligand for that connector, whereas the AAV VP2 domain is bound to said high affinity ligand. For example, streptavidin may be the connector fused to the CRISPR enzyme, while biotin may be bound to the AAV VP2 domain. Upon co-localization, the streptavidin will bind to the biotin, thus connecting the CRISPR enzyme to the AAV VP2 domain. The reverse arrangement is also possible. In some embodiments, a biotinylation sequence (15 amino acids) could therefore be fused to the AAV VP2 domain, especially the N-terminus of the AAV VP2 domain. A fusion of the CRISPR enzyme with streptavidin is also preferred, in some embodiments. In some embodiments, the biotinylated AAV capsids with streptavidin-CRISPR enzyme are assembled in vitro. This way the AAV capsids should assemble in a straightforward manner and the CRISPR enzyme-streptavidin fusion can be added after assembly of the capsid. In other embodiments a biotinylation sequence (15 amino acids) could therefore be fused to the CRISPR enzyme, together with a fusion of the AAV VP2 domain, especially the N-terminus of the AAV VP2 domain, with streptavidin. For simplicity, a fusion of the CRISPR enzyme and the AAV VP2 domain is preferred in some embodiments. In some embodiments, the fusion may be to the N-terminal end of the CRISPR enzyme. In other words, in some embodiments, the AAV and CRISPR enzyme are associated via fusion. In some embodiments, the AAV and CRISPR enzyme are associated via fusion including a linker. Suitable linkers are discussed herein, but include Gly Ser linkers. Fusion to the N-term of AAV VP2 domain is preferred, in some embodiments. In some embodiments, the CRISPR enzyme comprises at least one Nuclear Localization Signal (NLS). In an aspect, the present invention provides a polynucleotide encoding the present CRISPR enzyme and associated AAV VP2 domain.

Viral delivery vectors, for example modified viral delivery vectors, are hereby provided. While the AAV may advantageously be a vehicle for providing RNA of the system, another vector may also deliver that RNA, and such other vectors are also herein discussed. In one aspect, the invention provides a non-naturally occurring modified AAV having a VP2-CRISPR enzyme capsid protein, wherein the CRISPR enzyme is part of or tethered to the VP2 domain. In some preferred embodiments, the CRISPR enzyme is fused to the VP2 domain so that, in another aspect, the invention provides a non-naturally occurring modified AAV having a VP2-CRISPR enzyme fusion capsid protein. The following embodiments apply equally to either modified AAV aspect, unless otherwise apparent. Thus, reference herein to a VP2-CRISPR enzyme capsid protein may also include a VP2-CRISPR enzyme fusion capsid protein. In some embodiments, the VP2-CRISPR enzyme capsid protein further comprises a linker. In some embodiments, the VP2-CRISPR enzyme capsid protein further comprises a linker, whereby the VP2-CRISPR enzyme is distanced from the remainder of the AAV. In some embodiments, the VP2-CRISPR enzyme capsid protein further comprises at least one protein complex, e.g., CRISPR complex, such as CRISPR-Cpf1 complex guide RNA that targets a particular DNA, TALE, etc. A CRISPR complex, such as CRISPR-Cas system comprising the VP2-CRISPR enzyme capsid protein and at least one CRISPR complex, such as CRISPR-Cpf1 complex guide RNA that targets a particular DNA, is also provided in one aspect. In general, in some embodiments, the AAV further comprises a repair template. It will be appreciated that comprises here may mean encompassed within the viral capsid or that the virus encodes the comprised protein. In some embodiments, one or more, preferably two or more guide RNAs, may be comprised/encompassed within the AAV vector. Two may be preferred, in some embodiments, as it allows for multiplexing or dual nickase approaches. Particularly for multiplexing, two or more guides may be used. In fact, in some embodiments, three or more, four or more, five or more, or even six or more guide RNAs may be comprised/encompassed within the AAV. More space has been freed up within the AAV by virtue of the fact that the AAV no longer needs to comprise/encompass the CRISPR enzyme. In each of these instances, a repair template may also be comprised/encompassed within the AAV. In some embodiments, the repair template corresponds to or includes the DNA target.

In a further aspect, the present invention provides compositions comprising the CRISPR enzyme and associated AAV VP2 domain or the polynucleotides or vectors described herein.

Also provided is a method of treating a subject in need thereof, comprising inducing gene editing by transforming the subject with the polynucleotide encoding the system or any of the present vectors. A suitable repair template may also be provided, for example delivered by a vector comprising said repair template. In some embodiments, a single vector provides the CRISPR enzyme through (association with the viral capsid) and at least one of: guide RNA; and/or a repair template. Also provided is a method of treating a subject in need thereof, comprising inducing transcriptional activation or repression by transforming the subject with the polynucleotide encoding the present system or any of the present vectors, wherein said polynucleotide or vector encodes or comprises the catalytically inactive CRISPR enzyme and one or more associated functional domains. Compositions comprising the present system for use in said method of treatment are also provided. A kit of parts may be provided including such compositions. Use of the present system in the manufacture of a medicament for such methods of treatment are also provided.

Also provided is a pharmaceutical composition comprising the CRISPR enzyme which is part of or tethered to a VP2 domain of Adeno-Associated Virus (AAV) capsid; or the non-naturally occurring modified AAV; or a polynucleotide encoding them.

Also provided is a complex of the CRISPR enzyme with a guide RNA, such as sgRNA. The complex may further include the target DNA.

A split CRISPR enzyme, approach may be used. The so-called 'split Cpf1' approach Split Cas allows for the following. The Caslis split into two pieces and each of these are fused to one half of a dimer. Upon dimerization, the two parts of the Cas are brought together and the reconstituted Cas has been shown to be functional. Thus, one part of the split Cas may be associated with one VP2 domain and second part of the split Cas may be associated with another VP2 domain. The two VP2 domains may be in the same or different capsid. In other words, the split parts of the Cpf1 could be on the same virus particle or on different virus particles.

In some embodiments, one or more functional domains may be associated with or tethered to CRISPR enzyme and/or may be associated with or tethered to modified guides via adaptor proteins. These can be used irrespective of the fact that the CRISPR enzyme may also be tethered to a virus outer protein or capsid or envelope, such as a VP2 domain or a capsid, via modified guides with aptamer RAN sequences that recognize correspond adaptor proteins.

In some embodiments, one or more functional domains comprise a transcriptional activator, repressor, a recombinase, a transposase, a histone remodeler, a demethylase, a DNA methyltransferase, a cryptochrome, a light inducible/controllable domain, a chemically inducible/controllable domain, an epigenetic modifying domain, or a combination thereof. Advantageously, the functional domain comprises an activator, repressor or nuclease.

In some embodiments, a functional domain can have methylase activity, demethylase activity, transcription activation activity, transcription repression activity, transcription release factor activity, histone modification activity, RNA cleavage activity or nucleic acid binding activity, or activity that a domain identified herein has.

Examples of activators include P65, a tetramer of the herpes simplex activation domain VP16, termed VP64, optimized use of VP64 for activation through modification of both the sgRNA design and addition of additional helper molecules, MS2, P65 and HSF lin the system called the synergistic activation mediator (SAM) (Konermann et al, "Genome-scale transcriptional activation by an engineered CRISPR-Cas9 complex," Nature 517(7536):583-8 (2015)); and examples of repressors include the KRAB (Kruppel-associated box) domain of Kox1 or SID domain (e.g.

SID4X); and an example of a nuclease or nuclease domain suitable for a functional domain comprises FokI.

Suitable functional domains for use in practice of the invention, such as activators, repressors or nucleases are also discussed in documents incorporated herein by reference, including the patents and patent publications herein-cited and incorporated herein by reference regarding general information on systems.

In some embodiments, the CRISPR enzyme comprises or consists essentially of or consists of a localization signal as, or as part of, the linker between the CRISPR enzyme and the AAV capsid, e.g., VP2. HA or Flag tags are also within the ambit of the invention as linkers as well as Glycine Serine linkers as short as GS up to (GGGGS)$_3$. In this regard it is mentioned that tags that can be used in embodiments of the invention include affinity tags, such as chitin binding protein (CBP), maltose binding protein (MBP), glutathione-S-transferase (GST), poly(His) tag; solubilization tags such as thioredoxin (TRX) and poly(NANP), MBP, and GST; chromatography tags such as those consisting of polyanionic amino acids, such as FLAG-tag; epitope tags such as V5-tag, Myc-tag, HA-tag and NE-tag; fluorescence tags, such as GFP and mCherry; protein tags that may allow specific enzymatic modification (such as biotinylation by biotin ligase) or chemical modification (such as reaction with FlAsH-EDT2 for fluorescence imaging).

Also provided is a method of treating a subject, e.g., a subject in need thereof, comprising inducing gene editing by transforming the subject with the AAV-CRISPR enzyme advantageously encoding and expressing in vivo the remaining portions of the system (e.g., RNA, guides). A suitable repair template may also be provided, for example delivered by a vector comprising said repair template. Also provided is a method of treating a subject, e.g., a subject in need thereof, comprising inducing transcriptional activation or repression by transforming the subject with the AAV-CRISPR enzyme advantageously encoding and expressing in vivo the remaining portions of the system (e.g., RNA, guides); advantageously in some embodiments the CRISPR enzyme is a catalytically inactive CRISPR enzyme and comprises one or more associated functional domains. Where any treatment is occurring ex vivo, for example in a cell culture, then it will be appreciated that the term 'subject' may be replaced by the phrase "cell or cell culture."

Compositions comprising the present system for use in said method of treatment are also provided. A kit of parts may be provided including such compositions. Use of the present system in the manufacture of a medicament for such methods of treatment are also provided. Use of the present system in screening is also provided by the present invention, e.g., gain of function screens. Cells which are artificially forced to overexpress a gene are be able to down regulate the gene over time (re-establishing equilibrium) e.g. by negative feedback loops. By the time the screen starts the unregulated gene might be reduced again.

In one aspect, the invention provides an engineered, non-naturally occurring system comprising a AAV-Cas protein and a guide RNA that targets a DNA molecule encoding a gene product in a cell, whereby the guide RNA targets the DNA molecule encoding the gene product and the Cas protein cleaves the DNA molecule encoding the gene product, whereby expression of the gene product is altered; and, wherein the Cas protein and the guide RNA do not naturally occur together. The invention comprehends the guide RNA comprising a guide sequence fused to a tracr sequence. In an embodiment of the invention the Cas protein is a type II CRISPR-Cas protein and in a preferred embodiment the Cas protein is a Cpf1 protein. The invention further comprehends the coding for the Cas protein being codon optimized for expression in a eukaryotic cell. In a preferred embodiment the eukaryotic cell is a mammalian cell and in a more preferred embodiment the mammalian cell is a human cell. In a further embodiment of the invention, the expression of the gene product is decreased.

In another aspect, the invention provides an engineered, non-naturally occurring vector system comprising one or more vectors comprising a first regulatory element operably linked to a CRISPR-Cas system guide RNA that targets a DNA molecule encoding a gene product and a AAV-Cas protein. The components may be located on same or different vectors of the system, or may be the same vector whereby the AAV-Cas protein also delivers the RNA of the system. The guide RNA targets the DNA molecule encoding the gene product in a cell and the AAV-Cas protein may cleaves the DNA molecule encoding the gene product (it may cleave one or both strands or have substantially no nuclease activity), whereby expression of the gene product is altered; and, wherein the AAV-Cas protein and the guide RNA do not naturally occur together. The invention comprehends the guide RNA comprising a guide sequence fused to a tracr sequence. In an embodiment of the invention the AAV-Cas protein is a type II AAV—CRISPR-Cas protein and in a preferred embodiment the AAV-Cas protein is a AAV-Cpf1 protein. The invention further comprehends the coding for the AAV-Cas protein being codon optimized for expression in a eukaryotic cell. In a preferred embodiment the eukaryotic cell is a mammalian cell and in a more preferred embodiment the mammalian cell is a human cell. In a further embodiment of the invention, the expression of the gene product is decreased.

In another aspect, the invention provides a method of expressing an effector protein and guide RNA in a cell comprising introducing the vector according any of the vector delivery systems disclosed herein. In an embodiment of the vector for delivering an effector protein, the minimal promoter is the Mecp2 promoter, tRNA promoter, or U6. In a further embodiment, the minimal promoter is tissue specific.

The one or more polynucleotide molecules may be comprised within one or more vectors. The invention comprehends such polynucleotide molecule(s), for instance such polynucleotide molecules operably configured to express the protein and/or the nucleic acid component(s), as well as such vector(s).

In one aspect, the invention provides a vector system comprising one or more vectors. In some embodiments, the system comprises: (a) a first regulatory element operably linked to a tracr mate sequence and one or more insertion sites for inserting one or more guide sequences upstream of the tracr mate sequence, wherein when expressed, the guide sequence directs sequence-specific binding of a AAV-CRISPR complex to a target sequence in a eukaryotic cell, wherein the CRISPR complex comprises a AAV-CRISPR enzyme complexed with (1) the guide sequence that is hybridized to the target sequence, and (2) the tracr mate sequence that is hybridized to the tracr sequence; and (b) said AAV-CRISPR enzyme comprising at least one nuclear localization sequence and/or at least one NES; wherein components (a) and (b) are located on or in the same or different vectors of the system. In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of a AAV-CRISPR complex to a different target sequence in a eukaryotic cell. In some embodiments, the system comprises the tracr sequence under the control of a third regulatory element, such as a polymerase III promoter. In some embodiments, the tracr sequence exhibits at least 50%, 60%, 70%, 80%, 90%, 95%, or 99% of sequence complementarity along the length of the tracr mate sequence when optimally aligned. Determining optimal alignment is within the purview of one of skill in the art. For example, there are publically and commercially available alignment algorithms and programs such as, but not limited to, ClustalW, Smith-Waterman in matlab, Bowtie, Geneious, Biopython and SeqMan. In some embodiments, the AAV-CRISPR complex comprises one or more nuclear localization sequences of sufficient strength to drive accumulation of said CRISPR complex in a detectable amount in the nucleus of a eukaryotic cell. Without wishing to be bound by theory, it is believed that a nuclear localization sequence is not necessary for AAV-CRISPR complex activity in eukaryotes, but that including such sequences enhances activity of the system, especially as to targeting nucleic acid molecules in the nucleus and/or having molecules exit the nucleus. In some embodiments, the AAV-CRISPR enzyme is a type V-U5 AAV-CRISPR system enzyme. In some embodiments, the AAV-CRISPR enzyme is a AAV-c2c5 enzyme.

Examples of delivery methods and vehicles include viruses, nanoparticles, exosomes, nanoclews, liposomes, lipids (e.g., LNPs), supercharged proteins, cell permeabilizing peptides, and implantable devices. The nucleic acids, proteins and other molecules, as well as cells described herein may be delivered to cells, tissues, organs, or subjects using methods described in paragraphs [00117] to [00278] of Feng Zhang et al., (WO2016106236A1), which is incorporated by reference herein in its entirety.

Targeting Moieties

The system may further comprise one or more targeting moieties or polynucleotides encoding thereof. The targeting moieties may actively target a lipid entity of the invention, e.g., lipid particle or nanoparticle or liposome or lipid bilayer of the invention comprising a targeting moiety for active targeting.

With regard to targeting moieties, mention is made of Deshpande et al, "Current trends in the use of liposomes for tumor targeting," Nanomedicine (Lond). 8(9), doi:10.2217/nnm.13.118 (2013), and the documents it cites, all of which are incorporated herein by reference. Mention is also made of WO/2016/027264, and the documents it cites, all of which are incorporated herein by reference. And mention is made of Lorenzer et al, "Going beyond the liver: Progress and challenges of targeted delivery of siRNA therapeutics," Journal of Controlled Release, 203: 1-15 (2015), and the documents it cites, all of which are incorporated herein by reference.

An actively targeting lipid particle or nanoparticle or liposome or lipid bilayer delivery system (generally as to embodiments of the invention, "lipid entity of the invention" delivery systems) are prepared by conjugating targeting moieties, including small molecule ligands, peptides and monoclonal antibodies, on the lipid or liposomal surface; for example, certain receptors, such as folate and transferrin (Tf) receptors (TfR), are overexpressed on many cancer cells and have been used to make liposomes tumor cell specific. Liposomes that accumulate in the tumor microenvironment can be subsequently endocytosed into the cells by interacting with specific cell surface receptors. To efficiently target liposomes to cells, such as cancer cells, it is useful that the targeting moiety have an affinity for a cell surface receptor and to link the targeting moiety in sufficient quantities to have optimum affinity for the cell surface receptors; and determining these aspects are within the ambit of the skilled artisan. In the field of active targeting, there are a number of cell-, e.g., tumor-, specific targeting ligands.

Also as to active targeting, with regard to targeting cell surface receptors such as cancer cell surface receptors, targeting ligands on liposomes can provide attachment of liposomes to cells, e.g., vascular cells, via a noninternalizing epitope; and, this can increase the extracellular concentration of that which is being delivered, thereby increasing the amount delivered to the target cells. A strategy to target cell surface receptors, such as cell surface receptors on cancer cells, such as overexpressed cell surface receptors on cancer cells, is to use receptor-specific ligands or antibodies. Many cancer cell types display upregulation of tumor-specific receptors. For example, TfRs and folate receptors (FRs) are greatly overexpressed by many tumor cell types in response to their increased metabolic demand. Folic acid can be used as a targeting ligand for specialized delivery owing to its ease of conjugation to nanocarriers, its high affinity for FRs and the relatively low frequency of FRs, in normal tissues as compared with their overexpression in activated macrophages and cancer cells, e.g., certain ovarian, breast, lung, colon, kidney and brain tumors. Overexpression of FR on macrophages is an indication of inflammatory diseases, such as psoriasis, Crohn's disease, rheumatoid arthritis and atherosclerosis; accordingly, folate-mediated targeting of the invention can also be used for studying, addressing or treating inflammatory disorders, as well as cancers. Folate-linked lipid particles or nanoparticles or liposomes or lipid bylayers of the invention ("lipid entity of the invention") deliver their cargo intracellularly through receptor-mediated endocytosis. Intracellular trafficking can be directed to acidic compartments that facilitate cargo release, and, most importantly, release of the cargo can be altered or delayed until it reaches the cytoplasm or vicinity of target organelles. Delivery of cargo using a lipid entity of the invention having a targeting moiety, such as a folate-linked lipid entity of the invention, can be superior to nontargeted lipid entity of the invention. The attachment of folate directly to the lipid head groups may not be favorable for intracellular delivery of folate-conjugated lipid entity of the invention, since they may not bind as efficiently to cells as folate attached to the lipid entity of the invention surface by a spacer, which may enter cancer cells more efficiently. A lipid entity of the invention coupled to folate can be used for the delivery of complexes of lipid, e.g., liposome, e.g., anionic liposome and virus or capsid or envelope or virus outer protein, such as those herein discussed such as adenovirous or AAV. Tf is a monomeric serum glycoprotein of approximately 80 KDa involved in the transport of iron throughout the body. Tf binds to the TfR and translocates into cells via receptor-mediated endocytosis. The expression of TfR is can be higher in certain cells, such as tumor cells (as compared with normal cells and is associated with the increased iron demand in rapidly proliferating cancer cells. Accordingly, the invention comprehends a TfR-targeted lipid entity of the invention, e.g., liver cells, such as liver cancer, breast cells such as breast cancer cells, colon cells such as colon cancer cells, ovarian cells such as ovarian cancer cells, head, neck and lung cells, such as head, neck and non-small-cell lung cancer cells, and cells of the mouth such as oral tumor cells.

Also as to active targeting, a lipid entity of the invention can be multifunctional, i.e., employ more than one targeting moiety such as CPP, along with Tf; a bifunctional system; e.g., a combination of Tf and poly-L-arginine which can provide transport across the endothelium of the blood-brain barrier. EGFR, is a tyrosine kinase receptor belonging to the ErbB family of receptors that mediates cell growth, differentiation and repair in cells, especially non-cancerous cells, but EGF is overexpressed in certain cells such as many solid tumors, including colorectal, non-small-cell lung cancer, squamous cell carcinoma of the ovary, kidney, head, pancreas, neck and prostate, and especially breast cancer. The invention comprehends EGFR-targeted monoclonal antibody(ies) linked to a lipid entity of the invention. HER-2 is often overexpressed in patients with breast cancer, and is also associated with lung, bladder, prostate, brain and stomach cancers. HER-2, encoded by the ERBB2 gene. The invention comprehends a HER-2-targeting lipid entity of the invention, e.g., an anti-HER-2-antibody(or binding fragment thereof)-lipid entity of the invention, a HER-2-targeting-PEGylated lipid entity of the invention (e.g., having an anti-HER-2-antibody or binding fragment thereof), a HER-2-targeting-maleimide-PEG polymer-lipid entity of the invention (e.g., having an anti-HER-2-antibody or binding fragment thereof). Upon cellular association, the receptor-antibody complex can be internalized by formation of an endosome for delivery to the cytoplasm. With respect to receptor-mediated targeting, the skilled artisan takes into consideration ligand/target affinity and the quantity of receptors on the cell surface, and that PEGylation can act as a barrier against interaction with receptors. The use of antibody-lipid entity of the invention targeting can be advantageous. Multivalent presentation of targeting moieties can also increase the uptake and signaling properties of antibody fragments. In practice of the invention, the skilled person takes into account ligand density (e.g., high ligand densities on a lipid entity of the invention may be advantageous for increased binding to target cells). Preventing early by macrophages can be addressed with a sterically stabilized lipid entity of the invention and linking ligands to the terminus of molecules such as PEG, which is anchored in the lipid entity of the invention (e.g., lipid particle or nanoparticle or liposome or lipid bilayer). The microenvironment of a cell mass such as a tumor microenvironment can be targeted; for instance, it may be advantageous to target cell mass vasculature, such as the tumor vasculature microenvironment. Thus, the invention comprehends targeting VEGF. VEGF and its receptors are well-known proangiogenic molecules and are well-characterized targets for antiangiogenic therapy. Many small-molecule inhibitors of receptor tyrosine kinases, such as VEGFRs or basic FGFRs, have been developed as anticancer agents and the invention comprehends coupling any one or more of these peptides to a lipid entity of the invention, e.g., phage IVO peptide(s) (e.g., via or with a PEG terminus), tumor-homing peptide APRPG such as APRPG-PEG-modified. VCAM, the vascular endothelium plays a key role in the pathogenesis of inflammation, thrombosis and atherosclerosis. CAMs are involved in inflammatory disorders, including cancer, and are a logical target, E- and P-selectins, VCAM-1 and ICAMs. Can be used to target a lipid entity of the invention., e.g., with PEGylation. Matrix metalloproteases (MMPs) belong to the family of zinc-dependent endopeptidases. They are involved in tissue remodeling, tumor invasiveness, resistance to apoptosis and metastasis. There are four MMP inhibitors called TIMP1-4, which determine the balance between tumor growth inhibition and metastasis; a protein involved in the angiogenesis of tumor vessels is MT1-MMP, expressed on newly formed vessels and tumor tissues. The proteolytic activity of MT1-MMP cleaves proteins, such as fibronectin, elastin, collagen and laminin, at the plasma membrane and activates soluble MMPs, such as MMP-2, which degrades the matrix. An antibody or fragment thereof such as a Fab' fragment can be used in the practice of the invention such as for an antihuman MT1-MMP monoclonal antibody linked to a lipid entity of the invention, e.g., via a spacer such as a PEG spacer. a α-integrins or integrins are a group of transmembrane glycoprotein receptors that mediate attachment between a cell and its surrounding tissues or extracellular matrix. Integrins contain two distinct chains (heterodimers) called α- and β-subunits. The tumor tissue-specific expression of integrin receptors can be been utilized for targeted delivery in the invention, e.g., whereby the targeting moiety can be an RGD peptide such as a cyclic RGD. Aptamers are ssDNA or RNA oligonucleotides that impart high affinity and specific recognition of the target molecules by electrostatic interactions, hydrogen bonding and hydrophobic interactions as opposed to the Watson-Crick base pairing, which is typical for the bonding interactions of oligonucleotides. Aptamers as a targeting moiety can have advantages over antibodies: aptamers can demonstrate higher target antigen recognition as compared with antibodies; aptamers can be more stable and smaller in size as compared with antibodies; aptamers can be easily synthesized and chemically modified for molecular conjugation; and aptamers can be changed in sequence for improved selectivity and can be developed to recognize poorly immunogenic targets. Such moieties as a sgc8 aptamer can be used as a targeting moiety (e.g., via covalent linking to the lipid entity of the invention, e.g., via a spacer, such as a PEG spacer). The targeting moiety can be stimuli-sensitive, e.g., sensitive to an externally applied stimuli, such as magnetic fields, ultrasound or light; and pH-triggering can also be used, e.g., a labile linkage can be used between a hydrophilic moiety such as PEG and a hydrophobic moiety such as a lipid entity of the invention, which is cleaved only upon exposure to the relatively acidic conditions characteristic of the a particular environment or microenvironment such as an endocytic vacuole or the acidotic tumor mass. pH-sensitive copolymers can also be incorporated in embodiments of the invention can provide shielding; diortho esters, vinyl esters, cysteine-cleavable lipopolymers, double esters and hydrazones are a few examples of pH-sensitive bonds that are quite stable at pH 7.5, but are hydrolyzed relatively rapidly at pH 6 and below, e.g., a terminally alkylated copolymer of N-isopropylacrylamide and methacrylic acid that copolymer facilitates destabilization of a lipid entity of the invention and release in compartments with decreased pH value; or, the invention comprehends ionic polymers for generation of a pH-responsive lipid entity of the invention (e.g., poly (methacrylic acid), poly(diethylaminoethyl methacrylate), poly(acrylamide) and poly(acrylic acid)). Temperature-triggered delivery is also within the ambit of the invention. Many pathological areas, such as inflamed tissues and tumors, show a distinctive hyperthermia compared with normal tissues. Utilizing this hyperthermia is an attractive strategy in cancer therapy since hyperthermia is associated with increased tumor permeability and enhanced uptake. This technique involves local heating of the site to increase microvascular pore size and blood flow, which, in turn, can result in an increased extravasation of embodiments of the invention. Temperature-sensitive lipid entity of the invention can be prepared from thermosensitive lipids or polymers with a low critical solution temperature. Above the low critical solution temperature (e.g., at site such as tumor site or inflamed tissue site), the polymer precipitates, disrupting the liposomes to release. Lipids with a specific gel-to-liquid phase transition temperature are used to prepare these lipid entities of the invention; and a lipid for a thermosensitive embodiment can be dipalmitoylphosphatidylcholine. Thermosensitive polymers can also facilitate destabilization followed by release, and a useful thermosensitive polymer is poly (N-isopropylacrylamide). Another temperature triggered system can employ lysolipid temperature-sensitive liposomes. The invention also comprehends redox-triggered delivery: The difference in redox potential between normal and inflamed or tumor tissues, and between the intra- and extra-cellular environments has been exploited for delivery; e.g., GSH is a reducing agent abundant in cells, especially in the cytosol, mitochondria and nucleus. The GSH concentrations in blood and extracellular matrix are just one out of 100 to one out of 1000 of the intracellular concentration, respectively. This high redox potential difference caused by GSH, cysteine and other reducing agents can break the reducible bonds, destabilize a lipid entity of the invention and result in release of payload. The disulfide bond can be used as the cleavable/reversible linker in a lipid entity of the invention, because it causes sensitivity to redox owing to the disulfideto-thiol reduction reaction; a lipid entity of the invention can be made reduction sensitive by using two (e.g., two forms of a disulfide-conjugated multifunctional lipid as cleavage of the disulfide bond (e.g., via tris(2-carboxyethyl) phosphine, dithiothreitol, L-cysteine or GSH), can cause removal of the hydrophilic head group of the conjugate and alter the membrane organization leading to release of payload. Calcein release from reduction-sensitive lipid entity of the invention containing a disulfide conjugate can be more useful than a reduction-insensitive embodiment. Enzymes can also be used as a trigger to release payload. Enzymes, including MMPs (e.g. MMP2), phospholipase A2, alkaline phosphatase, transglutaminase or phosphatidylinositol-specific phospholipase C, have been found to be overexpressed in certain tissues, e.g., tumor tissues. In the presence of these enzymes, specially engineered enzyme-sensitive lipid entity of the invention can be disrupted and release the payload. an MMP2-cleavable octapeptide (Gly-Pro-Leu-Gly-Ile-Ala-Gly-Gln) can be incorporated into a linker, and can have antibody targeting, e.g., antibody 2C5. The invention also comprehends light- or energy-triggered delivery, e.g., the lipid entity of the invention can be light-sensitive, such that light or energy can facilitate structural and conformational changes, which lead to direct interaction of the lipid entity of the invention with the target cells via membrane fusion, photo-isomerism, photofragmentation or photopolymerization; such a moiety therefor can be benzoporphyrin photosensitizer. Ultrasound can be a form of energy to trigger delivery; a lipid entity of the invention with a small quantity of particular gas, including air or perfluorated hydrocarbon can be triggered to release with ultrasound, e.g., low-frequency ultrasound (LFUS). Magnetic delivery: A lipid entity of the invention can be magnetized by incorporation of magnetites, such as $Fe_3O_4$ or $\gamma$-$Fe_2O_3$, e.g., those that are less than 10 nm in size. Targeted delivery can be then by exposure to a magnetic field.

Also as to active targeting, the invention also comprehends intracellular delivery. Since liposomes follow the endocytic pathway, they are entrapped in the endosomes (pH 6.5-6) and subsequently fuse with lysosomes (pH<5), where they undergo degradation that results in a lower therapeutic potential. The low endosomal pH can be taken advantage of to escape degradation. Fusogenic lipids or peptides, which destabilize the endosomal membrane after the conformational transition/activation at a lowered pH. Amines are protonated at an acidic pH and cause endosomal swelling and rupture by a buffer effect Unsaturated dioleoylphosphatidylethanolamine (DOPE) readily adopts an inverted hexagonal shape at a low pH, which causes fusion of liposomes to the endosomal membrane. This process destabilizes a lipid entity containing DOPE and releases the cargo into the cytoplasm; fusogenic lipid GALA, cholesteryl-GALA and PEG-GALA may show a highly efficient endosomal release; a pore-forming protein listeriolysin 0 may provide an endosomal escape mechanism; and, histidine-rich peptides have the ability to fuse with the endosomal membrane, resulting in pore formation, and can buffer the proton pump causing membrane lysis.

Also as to active targeting, cell-penetrating peptides (CPPs) facilitate uptake of macromolecules through cellular membranes and, thus, enhance the delivery of CPP-modified molecules inside the cell. CPPs can be split into two classes: amphipathic helical peptides, such as transportan and MAP, where lysine residues are major contributors to the positive charge; and Arg-rich peptides, such as TATp, Antennapedia or penetratin. TATp is a transcription-activating factor with 86 amino acids that contains a highly basic (two Lys and six Arg among nine residues) protein transduction domain, which brings about nuclear localization and RNA binding. Other CPPs that have been used for the modification of liposomes include the following: the minimal protein transduction domain of Antennapedia, a Drosophilia homeoprotein, called penetratin, which is a 16-mer peptide (residues 43-58) present in the third helix of the homeodomain; a 27-amino acid-long chimeric CPP, containing the peptide sequence from the amino terminus of the neuropeptide galanin bound via the Lys residue, mastoparan, a wasp venom peptide; VP22, a major structural component of HSV-1 facilitating intracellular transport and transportan (18-mer) amphipathic model peptide that translocates plasma membranes of mast cells and endothelial cells by both energy-dependent and -independent mechanisms. The invention comprehends a lipid entity of the invention modified with CPP(s), for intracellular delivery that may proceed via energy dependent macropinocytosis followed by endosomal escape. The invention further comprehends organelle-specific targeting. A lipid entity of the invention surface-functionalized with the triphenylphosphonium (TPP) moiety or a lipid entity of the invention with a lipophilic cation, rhodamine 123 can be effective in delivery of cargo to mitochondria. DOPE/sphingomyelin/stearyl-octa-arginine can delivers cargos to the mitochondrial interior via membrane fusion. A lipid entity of the invention surface modified with a lysosomotropic ligand, octadecyl rhodamine B can deliver cargo to lysosomes. Ceramides are useful in inducing lysosomal membrane permeabilization; the invention comprehends intracellular delivery of a lipid entity of the invention having a ceramide. The invention further comprehends a lipid entity of the invention targeting the nucleus, e.g., via a DNA-intercalating moiety. The invention also comprehends multifunctional liposomes for targeting, i.e., attaching more than one functional group to the surface of the lipid entity of the invention, for instance to enhances accumulation in a desired site and/or promotes organelle-specific delivery and/or target a particular type of cell and/or respond to the local stimuli such as temperature (e.g., elevated), pH (e.g., decreased), respond to externally applied stimuli such as a magnetic field, light, energy, heat or ultrasound and/or promote intracellular delivery of the cargo. All of these are considered actively targeting moieties.

An embodiment of the system may comprise an actively targeting lipid particle or nanoparticle or liposome or lipid bilayer delivery system; or a lipid particle or nanoparticle or liposome or lipid bilayer comprising a targeting moiety whereby there is active targeting or wherein the targeting moiety is an actively targeting moiety. A targeting moiety can be one or more targeting moieties, and a targeting moiety can be for any desired type of targeting such as, e.g., to target a cell such as any herein-mentioned; or to target an organelle such as any herein-mentioned; or for targeting a response such as to a physical condition such as heat, energy, ultrasound, light, pH, chemical such as enzymatic, or magnetic stimuli; or to target to achieve a particular outcome such as delivery of payload to a particular location, such as by cell penetration.

It should be understood that as to each possible targeting or active targeting moiety herein-discussed, there is an aspect of the invention wherein the delivery system comprises such a targeting or active targeting moiety. Likewise, the following table provides exemplary targeting moieties that can be used in the practice of the invention and as to each an aspect of the invention provides a delivery system that comprises such a targeting moiety.

receptor for efficient transfection of breast cancer cells," J. Mol Pharm 6(4):1062-73; doi: 10.1021/mp800215d (2009); Sonoke et al, "Galactose-modified cationic liposomes as a liver-targeting delivery system for small interfering RNA," Biol Pharm Bull. 34(8):1338-42 (2011); Torchilin, "Antibody-modified liposomes for cancer chemotherapy," Expert Opin. Drug Deliv. 5 (9), 1003-1025 (2008); Manjappa et al, "Antibody derivatization and conjugation strategies: application in preparation of stealth immunoliposome to target chemotherapeutics to tumor," J. Control. Release 150 (1), 2-22 (2011); Sofou S "Antibody-targeted liposomes in cancer therapy and imaging," Expert Opin. Drug Deliv. 5 (2): 189-204 (2008); Gao J et al, "Antibody-targeted immunoliposomes for cancer treatment," Mini. Rev. Med. Chem. 13(14): 2026-2035 (2013); Molavi et al, "Anti-CD30 antibody conjugated liposomal doxorubicin with significantly improved therapeutic efficacy against anaplastic large cell lymphoma," Biomaterials 34(34):8718-25 (2013), each of which and the documents cited therein are hereby incorporated herein by reference).

Moreover, in view of the teachings herein the skilled artisan can readily select and apply a desired targeting moiety in the practice of the invention as to a lipid entity of

TABLE 4

Targeting moieties

| Targeting Moiety | Target Molecule | Target Cell or Tissue |
|---|---|---|
| folate | folate receptor | cancer cells |
| transferrin | transferrin receptor | cancer cells |
| Antibody CC52 | rat CC531 | rat colon adenocarcinoma CC531 |
| anti-HER2 antibody | HER2 | HER2-overexpressing tumors |
| anti-GD2 | GD2 | neuroblastoma, melanoma |
| anti-EGFR | EGFR | tumor cells overexpressing EGFR |
| pH-dependent fusogenic peptide diINF-7 | | ovarian carcinoma |
| anti-VEGFR | VEGF Receptor | tumor vasculature |
| anti-CD19 | CD19 (B cell marker) | leukemia, lymphoma |
| cell-penetrating peptide | | blood-brain barrier |
| cyclic arginine-glycine-aspartic acid-tyrosine-cysteine peptide (c(RGDyC)-LP) | $\alpha v \beta 3$ | glioblastoma cells, human umbilical vein endothelial cells, tumor angiogenesis |
| ASSHN peptide | | endothelial progenitor cells; anti-cancer |
| PR_b peptide | $\alpha_5\beta_1$ integrin | cancer cells |
| AG86 peptide | $\alpha_6\beta_4$ integrin | cancer cells |
| KCCYSL (P6.1 peptide) | HER-2 receptor | cancer cells |
| affinity peptide LN (YEVGHRC) | Aminopeptidase N (APN/CD13) | APN-positive tumor |
| synthetic somatostatin analogue | Somatostatin receptor 2 (SSTR2) | breast cancer |
| anti-CD20 monoclonal antibody | B-lymphocytes | B cell lymphoma |

Thus, in an embodiment, the targeting moiety comprises a receptor ligand, such as, for example, hyaluronic acid for CD44 receptor, galactose for hepatocytes, or antibody or fragment thereof such as a binding antibody fragment against a desired surface receptor, and as to each of a targeting moiety comprising a receptor ligand, or an antibody or fragment thereof such as a binding fragment thereof, such as against a desired surface receptor, there is an aspect of the invention wherein the delivery system comprises a targeting moiety comprising a receptor ligand, or an antibody or fragment thereof such as a binding fragment thereof, such as against a desired surface receptor, or hyaluronic acid for CD44 receptor, galactose for hepatocytes (see, e.g., Surace et al, "Lipoplexes targeting the CD44 hyaluronic acid the invention. The invention comprehends an embodiment wherein the delivery system comprises a lipid entity having a targeting moiety.

Dosage

In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N. J. 1991) which is incorporated by reference herein.

The relative dosages of gene editing components may be important in some applications. In some examples, expression of one or more components of the complex is involved, which may be for example from the same or separate vectors. In the single vector case, it will often be advantageous to vary the effector protein:guide ratio by adjusting the expression levels of the effector protein and guide. In the case of multiple vectors, it will often be advantageous to vary the effector protein:guide ratio by adjusting the doses of the separate vectors and/or the expression levels of the effector protein and guide from the vectors. In certain embodiments, the ratios of vectors for expression of the effector protein and guide are adjusted. For example, the relative doses of an AAV-effector protein expression vector and an AAV-guide expression vector can be adjusted. Usually, the doses are expressed in terms of vector genomes (vg) per ml (vg/ml) or per kg (vg/kg). In certain embodiments, the ratio of vector genomes of the AAV-effector protein and AAV-guide is about 2:1, or about 1:1, or about 1:2, or about 1:4, or about 1:5, or about 1:10, or about 1:20, or from about 2:1 to about 1:1, or from about 2:1 to about 1:2, or from about 1:1 to about 1:2 or from about 1:1 to about 1:4, or from about 1:2 to about 1:5, or from about 1:2 to about 1:10 or from about 1:5 to about 1:20. Similarly, where guides are multiplexed, it can advantageous to vary the ratio of vector genomes to guide genome separately for each guide.

In an embodiment herein the delivery is via an adenovirus, which may be at a single dose or booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^{10}$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ particles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^1$ to about $1\times10^{10}$ functional AAV/ml solution. The dosage may be adjusted to balance the therapeutic benefit against any side effects. In an embodiment herein, the AAV dose is generally in the range of concentrations of from about $1\times10^5$ to $1\times10^{50}$ genomes AAV, from about $1\times10^8$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein, the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 μg to about 10 μg per 70 kg individual. Plasmids of the invention will generally comprise (i) a promoter; (ii) a sequence encoding a CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

The dosage used for the compositions provided herein include dosages for repeated administration or repeat dosing. In particular embodiments, the administration is repeated within a period of several weeks, months, or years. Suitable assays can be performed to obtain an optimal dosage regime. Repeated administration can allow the use of lower dosage, which can positively affect off-target modifications.

Application in Non-Animal Cell Types and Organisms

The systems and methods herein may be used in non-animal organisms, e.g., plants, fungi. The system(s) (e.g., single or multiplexed) can be used in conjunction with recent advances in crop genomics. The systems described herein can be used to perform efficient and cost effective plant gene or genome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The CRISPR effector protein system(s) can be used with regard to plants in Site-Directed Integration (SDI) or Gene Editing (GE) or any Near Reverse Breeding (NRB) or Reverse Breeding (RB) techniques. Aspects of utilizing the herein described CRISPR effector protein systems may be analogous to the use of the CRISPR-Cas (e.g. CRISPR-Cas9) system in plants, and mention is made of the University of Arizona website "CRISPR-PLANT" (www.genome.arizona.edu/crispr/) (supported by Penn State and AGI). Embodiments of the invention can be used with haploid induction. For example, a corn line capable of making pollen able to trigger haploid induction is transformed with a system programmed to target genes related to desirable traits. The pollen is used to transfer the system to other corn varieties otherwise resistant to CRISPR transfer. In certain embodiments, the CRISPR-carrying corn pollen can edit the DNA of wheat. Embodiments of the invention can be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi:10.1186/1746-4811-9-39); Brooks, "Efficient gene editing in tomato in the first generation using the CRISPR-Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi:10.1038/cr.2013.114; published online 20 Aug. 2013; Xie, "RNA-guided genome editing in plants using a CRISPR-Cas system," Mol Plant. 2013 November; 6(6):1975-83. doi: 10.1093/mp/sst119. Epub 2013 Aug. 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial *Populus* reveals 4-coumarate: CoA ligase specificity and Redundancy," New Phytologist (2015) (Forum) 1-4 (available online only at www.newphytologist.com); Caliando et al, "Targeted DNA degradation using a CRISPR device stably carried in the host genome, NATURE COMMUNICATIONS 6:6989, DOI: 10.1038/ncomms7989, www.nature.com/naturecommunications DOI: 10.1038/ncomms7989; U.S. Pat. No. 6,603,061—*Agrobacterium*-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety.

In the practice of the invention, the contents and disclosure of Morrell et al. "Crop genomics: advances and applications," Nat Rev Genet. 2011 Dec. 29; 13(2):85-96; each of which is incorporated by reference herein including as to how herein embodiments may be used as to plants. Accordingly, reference herein to animal cells may also apply, mutatis mutandis, to plant cells unless otherwise apparent; and, the enzymes herein having reduced off-target effects and systems employing such enzymes can be used in plant applications, including those mentioned herein.

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, *eucalyptus*, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, *papaya*, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for genome editing using the system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., *petunia*, rose, *chrysanthemum*), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Plant cells and tissues for engineering include, without limitation, roots, stems, leaves, flowers, and reproductive structures, undifferentiated meristematic cells, parenchyma, collenchyma, sclerenchyma, xylem, phloem, epidermis, and germplasm. Thus, the methods and systems can be used over a broad range of plants, such as for example with dicotyledonous plants belonging to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g those belonging to the orders Pinales, Ginkgoales, Cycadales, Araucariales, Cupressales and Gnetales.

The systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis*, and *Vigna*; and the genera *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum, Zea, Abies, Cunninghamia, Ephedra, Picea, Pinus*, and *Pseudotsuga*.

The systems and methods of use can also be used over a broad range of "algae" or "algae cells"; including for example algea selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Anikstrodesmis, Botryococcus, Chaetoceros, Chlamydomonas, Chlorella, Chlorococcum, Cyclotella, Cylindrotheca, Dunaliella, Emiliana, Euglena, Hematococcus, Isochrysis, Monochrysis, Monoraphidium, Nannochloris, Nannnochloropsis, Navicula, Nephrochloris, Nephroselmis, Nitzschia, Nodularia, Nostoc, Oochromonas, Oocystis, Oscillartoria, Pavlova, Phaeodactylum, Playtmonas, Pleurochrysis, Porhyra, Pseudoanabaena, Pyramimonas, Stichococcus, Synechococcus, Synechocystis, Tetraselmis, Thalassiosira*, and *Trichodesmium*.

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized units, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendants of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cererivisiae, Kluyveromyces marxianus*, or *Issatchenkia orientalis* cell. Other yeast cells may include without limitation *Candida* spp. (e.g., *Candida albicans*),

*Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., *Issatchenkia orientalis*, a.k.a. *Pichia* kudriavzevii and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guideRNA may more often be a rate-limiting component in genome engineering of polyploidy cells than in haploid cells, and thus the methods using the systems described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2μ plasmids, yeast integrative plasmids, yeast replicative plasmids, shuttle vectors, and episomal plasmids.

Stable Integration of in the Genome of Plants and Plant Cells

In particular embodiments, it is envisaged that the polynucleotides encoding the components of the system are introduced for stable integration into the genome of a plant cell. In these embodiments, the design of the transformation vector or the expression system can be adjusted depending on for when, where and under what conditions the guide RNA and/or the Cas gene are expressed.

In particular embodiments, it is envisaged to introduce the components of the system stably into the genomic DNA of a plant cell. Additionally or alternatively, it is envisaged to introduce the components of the system for stable integration into the DNA of a plant organelle such as, but not limited to a plastid, a mitochondrion or a chloroplast.

The expression system for stable integration into the genome of a plant cell may contain one or more of the following elements: a promoter element that can be used to express the RNA and/or CRISPR protein in a plant cell; a 5' untranslated region to enhance expression; an intron element to further enhance expression in certain cells, such as monocot cells; a multiple-cloning site to provide convenient restriction sites for inserting the guide RNA and/or the CRISPR gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a CRISPR expression system comprises at least:
  (a) a nucleotide sequence encoding a guide RNA (gRNA) that hybridizes with a target sequence in a plant, and wherein the guide RNA comprises a guide sequence and a direct repeat sequence, and
  (b) a nucleotide sequence encoding a Cas protein, wherein components (a) or (b) are located on the same or on different constructs, and whereby the different nucleotide sequences can be under control of the same or a different regulatory element operable in a plant cell.

DNA construct(s) containing the components of the system, and, where applicable, template sequence may be introduced into the genome of a plant, plant part, or plant cell by a variety of conventional techniques. The process generally comprises the steps of selecting a suitable host cell or host tissue, and introducing the construct(s) into the host cell or host tissue.

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome. (see e.g. Klein et al, Nature (1987), Klein et ah, Bio/Technology (1992), Casas et al., Proc. Natl. Acad. Sci. USA (1993)).

In particular embodiments, the DNA constructs containing components of the system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the system are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc.), or light inducible systems (Phytochrome, LOV domains, or cryptochrome), such as a Light Inducible Transcriptional Effector (LITE) that direct changes in transcriptional activity in a sequence-specific manner. The components of a light inducible system may include a Cas CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize 1n2-2 promoter, activated by benzene sulfonamide herbicide safeners (De Veylder et al., (1997) Plant Cell Physiol 38:568-77), the maize GST promoter (GST-11-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The system may comprise elements for translocation to and/or expression in a specific plant organelle.

Chloroplast Targeting

In particular embodiments, it is envisaged that the system is used to specifically modify chloroplast genes or to ensure expression in the chloroplast. For this purpose use is made of chloroplast transformation methods or compartmentalization of the systems components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the systems components to the plant chloroplast. This is achieved by incorporating in the expression construct a sequence encoding a chloroplast transit peptide (CTP) or plastid transit peptide, operably linked to the 5' region of the sequence encoding the Cas protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the guide RNA to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the Cas-guide RNA.

Introduction of Polynucleotides in Algal Cells

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species using Cas9. Using similar tools, the methods of the systems described herein can be applied on *Chlamydomonas* species and other algae. In particular embodiments, Cas and guide RNA are introduced in algae expressed using a vector that expresses Cas under the control of a constitutive promoter such as Hsp70A-Rbc S2 or Beta2-tubulin. Guide RNA is optionally delivered using a vector containing T7 promoter. Alternatively, Cas mRNA and in vitro transcribed guide RNA can be delivered to algal cells. Electroporation protocols are available to the skilled person such as the standard recommended protocol from the GeneArt *Chlamydomonas* Engineering kit.

In particular embodiments, the endonuclease used herein is a split Cas enzyme. Split Cas enzymes are preferentially used in Algae for targeted genome modification as has been described for Cas9 in WO 2015086795. Use of the Cas split system is particularly suitable for an inducible method of genome targeting and avoids the potential toxic effect of the Cas overexpression within the algae cell. In particular embodiments, said Cas split domains (RuvC and HNH domains in the case of Cas9) can be simultaneously or sequentially introduced into the cell such that said split Cas domain(s) process the target nucleic acid sequence in the algae cell. The reduced size of the split Cas compared to the wild type Cas allows other methods of delivery of the system to the cells, such as the use of Cell Penetrating Peptides as described herein. This method is of particular interest for generating genetically modified algae.

Introduction of Polynucleotides in Yeast Cells

In particular embodiments, the invention relates to the use of the system for genome editing of yeast cells. Methods for transforming yeast cells which can be used to introduce polynucleotides encoding the system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of CRISPR System Components in Plants and Plant Cell

In particular embodiments, it is envisaged that the guide RNA and/or Cas gene are transiently expressed in the plant cell. In these embodiments, the system can ensure modification of a target gene only when both the guide RNA and the Cas protein is present in a cell, such that genomic modification can further be controlled. As the expression of the Cas enzyme is transient, plants regenerated from such plant cells typically contain no foreign DNA. In particular embodiments, the Cas enzyme is stably expressed by the plant cell and the guide sequence is transiently expressed.

In particular embodiments, the system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors.

In particular embodiments, the vector used for transient expression of Cas CRISPR constructs is for instance a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaLCuV) vector to express gRNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the Cas gene can be transiently introduced into the plant cell. In such embodiments, the introduced double-stranded DNA fragments are provided in sufficient quantity to modify the cell but do not persist after a contemplated period of time has passed or after one or more cell divisions. Methods for direct DNA transfer in plants are known by the skilled artisan (see for instance Davey et al. Plant Mol Biol. 1989 September; 13(3):273-85.)

In other embodiments, an RNA polynucleotide encoding the Cas protein is introduced into the plant cell, which is then translated and processed by the host cell generating the protein in sufficient quantity to modify the cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122).

Combinations of the different methods described above are also envisaged.

Delivery of Components of the Systems to the Plant Cell

In particular embodiments, it is of interest to deliver one or more components of the system directly to the plant cell. This is of interest, inter alia, for the generation of non-transgenic plants (see below). In particular embodiments, one or more of the Cas components is prepared outside the plant or plant cell and delivered to the cell. For instance in particular embodiments, the Cas protein is prepared in vitro prior to introduction to the plant cell. Cas protein can be prepared by various methods known by one of skill in the art and include recombinant production. After expression, the Cas protein is isolated, refolded if needed, purified and optionally treated to remove any purification tags, such as a His-tag. Once crude, partially purified, or more completely purified Cas protein is obtained, the protein may be introduced to the plant cell.

In particular embodiments, the Cas protein is mixed with guide RNA targeting the gene of interest to form a pre-assembled ribonucleoprotein.

The individual components or pre-assembled ribonucleoprotein can be introduced into the plant cell via electroporation, by bombardment with Cas-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. Nature Biotechnology, 2015; DOI: 10.1038/nbt.3389).

In particular embodiments, the system components are introduced into the plant cells using nanoparticles. The components, either as protein or nucleic acid or in a combination thereof, can be uploaded onto or packaged in nanoparticles and applied to the plants (such as for instance described in WO 2008042156 and US 20130185823). In particular, embodiments of the invention comprise nanoparticles uploaded with or packed with DNA molecule(s) encoding the Cas protein, DNA molecules encoding the guide RNA and/or isolated guide RNA as described in WO2015089419.

Further means of introducing one or more components of the system to the plant cell is by using cell penetrating peptides (CPP). Accordingly, in particular embodiments the invention comprises compositions comprising a cell penetrating peptide linked to the Cas protein. In particular embodiments of the present invention, the Cas protein and/or guide RNA is coupled to one or more CPPs to effectively transport them inside plant protoplasts; see also Ramakrishna (2014) Genome Res. 2014 June; 24(6):1020-7 for Cas9 in human cells). In other embodiments, the Cas gene and/or guide RNA are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipathic peptides, peptides having proline-rich and anti-microbial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biomolecule with the target. Examples of CPP include amongst others: Tat, a nuclear transcriptional activator protein required for viral replication by HIV type 1, penetratin, Kaposi fibroblast growth factor (FGF) signal peptide sequence, integrin (33 signal peptide sequence, polyarginine peptide Args sequence, Guanine rich-molecular transporters, sweet arrow peptide, etc.

Making Genetically Modified Non-Transgenic Plants

In particular embodiments, the systems and methods described herein are used to modify endogenous genes or to modify their expression without the permanent introduction into the genome of the plant of any foreign gene, including those encoding CRISPR components, so as to avoid the presence of foreign DNA in the genome of the plant. This can be of interest as the regulatory requirements for non-transgenic plants are less rigorous.

In particular embodiments, this is ensured by transient expression of the systems components. In particular embodiments one or more of the systems components are expressed on one or more viral vectors which produce sufficient components of the systems to consistently steadily ensure modification of a gene of interest according to a method described herein.

In particular embodiments, transient expression of constructs is ensured in plant protoplasts and thus not integrated into the genome. The limited window of expression can be sufficient to allow the system to ensure modification of a target gene as described herein.

In particular embodiments, the different components of the system are introduced in the plant cell, protoplast or plant tissue either separately or in mixture, with the aid of particulate delivering molecules such as nanoparticles or CPP molecules as described herein above.

The expression of the components of the systems herein can induce targeted modification of the genome, either by direct activity of the Cas nuclease and optionally introduction of template DNA or by modification of genes targeted using the system as described herein. The different strategies described herein above allow Cas-mediated targeted genome editing without requiring the introduction of the components into the plant genome. Components which are transiently introduced into the plant cell are typically removed upon crossing.

Detecting Modifications in the Plant Genome-Selectable Markers

In particular embodiments, where the method involves modification of an endogenous target gene of the plant genome, any suitable method can be used to determine, after the plant, plant part or plant cell is infected or transfected with the system, whether gene targeting or targeted mutagenesis has occurred at the target site. Where the method involves introduction of a transgene, a transformed plant cell, callus, tissue or plant may be identified and isolated by selecting or screening the engineered plant material for the presence of the transgene or for traits encoded by the transgene. Physical and biochemical methods may be used to identify plant or plant cell transformants containing inserted gene constructs or an endogenous DNA modification. These methods include but are not limited to: 1) Southern analysis or PCR amplification for detecting and determining the structure of the recombinant DNA insert or modified endogenous genes; 2) Northern blot, S1 RNase protection, primer-extension or reverse transcriptase-PCR amplification for detecting and examining RNA transcripts of the gene constructs; 3) enzymatic assays for detecting enzyme or ribozyme activity, where such gene products are encoded by the gene construct or expression is affected by the genetic modification; 4) protein gel electrophoresis, Western blot techniques, immunoprecipitation, or enzyme-linked immunoassays, where the gene construct or endogenous gene products are proteins. Additional techniques, such as in situ hybridization, enzyme staining, and immunostaining, also may be used to detect the presence or expression of the recombinant construct or detect a modification of endogenous gene in specific plant organs and tissues. The methods for doing all these assays are well known to those skilled in the art.

Additionally (or alternatively), the expression system encoding the systems components is typically designed to comprise one or more selectable or detectable markers that provide a means to isolate or efficiently select cells that contain and/or have been modified by the system at an early stage and on a large scale.

In the case of *Agrobacterium*-mediated transformation, the marker cassette may be adjacent to or between flanking T-DNA borders and contained within a binary vector. In another embodiment, the marker cassette may be outside of the T-DNA. A selectable marker cassette may also be within or adjacent to the same T-DNA borders as the expression cassette or may be somewhere else within a second T-DNA on the binary vector (e.g., a 2 T-DNA system).

For particle bombardment or with protoplast transformation, the expression system can comprise one or more isolated linear fragments or may be part of a larger construct that might contain bacterial replication elements, bacterial selectable markers or other detectable elements. The expression cassette(s) comprising the polynucleotides encoding the guide and/or Cas may be physically linked to a marker cassette or may be mixed with a second nucleic acid molecule encoding a marker cassette. The marker cassette is comprised of necessary elements to express a detectable or selectable marker that allows for efficient selection of transformed cells.

The selection procedure for the cells based on the selectable marker will depend on the nature of the marker gene. In particular embodiments, use is made of a selectable marker, i.e. a marker which allows a direct selection of the cells based on the expression of the marker. A selectable marker can confer positive or negative selection and is conditional or non-conditional on the presence of external substrates (Miki et al. 2004, 107(3): 193-232). Most commonly, antibiotic or herbicide resistance genes are used as a marker, whereby selection is performed by growing the engineered plant material on media containing an inhibitory amount of the antibiotic or herbicide to which the marker gene confers resistance. Examples of such genes are genes that confer resistance to antibiotics, such as hygromycin (hpt) and kanamycin (nptII), and genes that confer resistance to herbicides, such as phosphinothricin (bar) and chlorosulfuron (als).

Transformed plants and plant cells may also be identified by screening for the activities of a visible marker, typically an enzyme capable of processing a colored substrate (e.g., the β-glucuronidase, luciferase, B or C1 genes). Such selection and screening methodologies are well known to those skilled in the art.

Plant Cultures and Regeneration

In particular embodiments, plant cells which have a modified genome and that are produced or obtained by any of the methods described herein, can be cultured to regenerate a whole plant which possesses the transformed or modified genotype and thus the desired phenotype. Conventional regeneration techniques are well known to those skilled in the art. Particular examples of such regeneration techniques rely on manipulation of certain phytohormones in a tissue culture growth medium, and typically relying on a biocide and/or herbicide marker which has been introduced together with the desired nucleotide sequences. In further particular embodiments, plant regeneration is obtained from cultured protoplasts, plant callus, explants, organs, pollens, embryos or parts thereof (see e.g. Evans et al. (1983), Handbook of Plant Cell Culture, Klee et al (1987) Ann. Rev. of Plant Phys.).

In particular embodiments, transformed or improved plants as described herein can be self-pollinated to provide seed for homozygous improved plants of the invention (homozygous for the DNA modification) or crossed with non-transgenic plants or different improved plants to provide seed for heterozygous plants. Where a recombinant DNA was introduced into the plant cell, the resulting plant of such a crossing is a plant which is heterozygous for the recombinant DNA molecule. Both such homozygous and heterozygous plants obtained by crossing from the improved plants and comprising the genetic modification (which can be a recombinant DNA) are referred to herein as "progeny". Progeny plants are plants descended from the original transgenic plant and containing the genome modification or recombinant DNA molecule introduced by the methods provided herein. Alternatively, genetically modified plants can be obtained by one of the methods described supra using the Cfp1 enzyme whereby no foreign DNA is incorporated into the genome. Progeny of such plants, obtained by further breeding may also contain the genetic modification. Breedings are performed by any breeding methods that are commonly used for different crops (e.g., Allard, Principles of Plant Breeding, John Wiley & Sons, NY, U. of CA, Davis, Calif., 50-98 (1960)).

Generation of Plants with Enhanced Agronomic Traits

The systems provided herein can be used to introduce targeted double-strand or single-strand breaks and/or to introduce gene activator and or repressor systems and without being limitative, can be used for gene targeting, gene replacement, targeted mutagenesis, targeted deletions or insertions, targeted inversions and/or targeted translocations. By co-expression of multiple targeting RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

In particular embodiments, the system as described herein is used to introduce targeted double-strand breaks (DSB) in an endogenous DNA sequence. The DSB activates cellular DNA repair pathways, which can be harnessed to achieve desired DNA sequence modifications near the break site. This is of interest where the inactivation of endogenous genes can confer or contribute to a desired trait. In particular embodiments, homologous recombination with a template sequence is promoted at the site of the DSB, in order to introduce a gene of interest.

In particular embodiments, the system may be used as a generic nucleic acid binding protein with fusion to or being operably linked to a functional domain for activation and/or repression of endogenous plant genes. Exemplary functional domains may include but are not limited to translational initiator, translational activator, translational repressor, nucleases, in particular ribonucleases, a spliceosome, beads, a light inducible/controllable domain or a chemically inducible/controllable domain. Typically in these embodiments, the Cas protein comprises at least one mutation, such that it has no more than 5% of the activity of the Cas protein not having the at least one mutation; the guide RNA comprises a guide sequence capable of hybridizing to a target sequence.

The methods described herein generally result in the generation of "improved plants" in that they have one or more desirable traits compared to the wildtype plant. In particular embodiments, the plants, plant cells or plant parts obtained are transgenic plants, comprising an exogenous DNA sequence incorporated into the genome of all or part of the cells of the plant. In particular embodiments, non-transgenic genetically modified plants, plant parts or cells are obtained, in that no exogenous DNA sequence is incorporated into the genome of any of the plant cells of the plant. In such embodiments, the improved plants are non-transgenic. Where only the modification of an endogenous gene is ensured and no foreign genes are introduced or maintained in the plant genome, the resulting genetically modified crops contain no foreign genes and can thus basically be considered non-transgenic. The different applications of the system for plant genome editing are described more in detail below.

Introduction of One or More Foreign Genes to Confer an Agricultural Trait of Interest The invention provides methods of genome editing or modifying sequences associated with or at a target locus of interest wherein the method comprises introducing a system into a plant cell, whereby the system effectively functions to integrate a DNA insert, e.g. encoding a foreign gene of interest, into the genome of the plant cell. In preferred embodiments the integration of the DNA insert is facilitated by HR with an exogenously introduced DNA template or repair template. Typically, the exogenously introduced DNA template or repair template is delivered together with the system or one component or a polynucleotide vector for expression of a component of the complex.

The systems provided herein allow for targeted gene delivery. It has become increasingly clear that the efficiency of expressing a gene of interest is to a great extent determined by the location of integration into the genome. The present methods allow for targeted integration of the foreign gene into a desired location in the genome. The location can be selected based on information of previously generated events or can be selected by methods disclosed elsewhere herein.

In particular embodiments, the methods provided herein include (a) introducing into the cell a Cas CRISPR complex comprising a guide RNA, comprising a direct repeat and a guide sequence, wherein the guide sequence hybridizes to a target sequence that is endogenous to the plant cell; (b) introducing into the plant cell a Cas effector molecule which complexes with the guide RNA when the guide sequence hybridizes to the target sequence and induces a double strand break at or near the sequence to which the guide sequence is targeted; and (c) introducing into the cell a nucleotide sequence encoding an HDR repair template which encodes the gene of interest and which is introduced into the location of the DS break as a result of HDR. In particular embodiments, the step of introducing can include delivering to the plant cell one or more polynucleotides encoding Cas effector protein, the guide RNA and the repair template. In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cas effector protein, the guide RNA and the repair template, where the delivering is via *Agrobacterium*. The nucleic acid sequence encoding the Cas effector protein can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the repair template i.e. the gene of interest has been introduced. In particular embodiments, the methods include the step of regenerating a plant from the plant cell. In further embodiments, the methods include cross breeding the plant to obtain a genetically desired plant lineage. Examples of foreign genes encoding a trait of interest are listed below.

Editing of Endogenous Genes to Confer an Agricultural Trait of Interest

The invention provides methods of genome editing or modifying sequences associated with or at a target locus of interest wherein the method comprises introducing a system into a plant cell, whereby the system modifies the expression of an endogenous gene of the plant. This can be achieved in different ways. In particular embodiments, the elimination of expression of an endogenous gene is desirable and the system is used to target and cleave an endogenous gene so as to modify gene expression. In these embodiments, the methods provided herein include (a) introducing into the plant cell a Cas CRISPR complex comprising a guide RNA, comprising a direct repeat and a guide sequence, wherein the guide sequence hybridizes to a target sequence within a gene of interest in the genome of the plant cell; and (b) introducing into the cell a Cas effector protein, which upon binding to the guide RNA comprises a guide sequence that is hybridized to the target sequence, ensures a double strand break at or near the sequence to which the guide sequence is targeted. In particular embodiments, the step of introducing can include delivering to the plant cell one or more polynucleotides encoding Cas effector protein and the guide RNA.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cas effector protein and the guide RNA, where the delivering is via *Agrobacterium*. The polynucleotide sequence encoding the components of the system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage.

In particular embodiments of the methods described above, disease resistant crops are obtained by targeted mutation of disease susceptibility genes or genes encoding negative regulators (e.g. Mlo gene) of plant defense genes. In a particular embodiment, herbicide-tolerant crops are generated by targeted substitution of specific nucleotides in plant genes such as those encoding acetolactate synthase (ALS) and protoporphyrinogen oxidase (PPO). In particular embodiments drought and salt tolerant crops by targeted mutation of genes encoding negative regulators of abiotic stress tolerance, low amylose grains by targeted mutation of Waxy gene, rice or other grains with reduced rancidity by targeted mutation of major lipase genes in aleurone layer, etc. In particular embodiments. A more extensive list of endogenous genes encoding a traits of interest are listed below.

Modulating of Endogenous Genes by the System to Confer an Agricultural Trait of Interest Also provided herein are methods for modulating (i.e. activating or repressing) endogenous gene expression using the systems herein. Such methods make use of distinct RNA sequence(s) which are targeted to the plant genome by the system. More particularly the distinct RNA sequence(s) bind to two or more adaptor proteins (e.g. aptamers) whereby each adaptor protein is associated with one or more functional domains and wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity; The functional domains are used to modulate expression of an endogenous plant gene so as to obtain the desired trait. Typically, in these embodiments, the Cas effector protein has one or more mutations such that it has no more than 5% of the nuclease activity.

In particular embodiments, the methods provided herein include the steps of (a) introducing into the cell a Cas CRISPR complex comprising a guide RNA, comprising a direct repeat and a guide sequence, wherein the guide sequence hybridizes to a target sequence that is endogenous to the plant cell; (b) introducing into the plant cell a Cas effector molecule which complexes with the guide RNA when the guide sequence hybridizes to the target sequence; and wherein either the guide RNA is modified to comprise a distinct RNA sequence (aptamer) binding to a functional domain and/or the Cas effector protein is modified in that it is linked to a functional domain. In particular embodiments, the step of introducing can include delivering to the plant cell one or more polynucleotides encoding the (modified) Cas effector protein and the (modified) guide RNA. The details the components of the system for use in these methods are described elsewhere herein.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cas effector protein and the guide RNA, where the delivering is via *Agrobacterium*. The nucleic acid sequence encoding the one or more components of the system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage. A more extensive list of endogenous genes encoding a traits of interest are listed below.

Modification of Polyploid Plants

Many plants are polyploid, which means they carry duplicate copies of their genomes—sometimes as many as six, as in wheat. The methods according to the present invention, which make use of the systems can be "multiplexed" to affect all copies of a gene, or to target dozens of genes at once. For instance, in particular embodiments, the methods of the present invention are used to simultaneously ensure a loss of function mutation in different genes responsible for suppressing defenses against a disease. In particular embodiments, the methods of the present invention are used to simultaneously suppress the expression of the TaMLO-A1, TaMLO-B1 and TaMLO-D1 nucleic acid sequence in a wheat plant cell and regenerating a wheat plant therefrom, in order to ensure that the wheat plant is resistant to powdery mildew (see also WO2015109752).

Exemplary Genes Conferring Agronomic Traits

As described herein above, in particular embodiments, the invention encompasses the use of the system as described herein for the insertion of a DNA of interest, including one or more plant expressible gene(s). In further particular embodiments, the invention encompasses methods and tools using the system as described herein for partial or complete deletion of one or more plant expressed gene(s). In other further particular embodiments, the invention encompasses methods and tools using the system as described herein to ensure modification of one or more plant-expressed genes by mutation, substitution, insertion of one of more nucleotides. In other particular embodiments, the invention encompasses the use of system as described herein to ensure modification of expression of one or more plant-expressed genes by specific modification of one or more of the regulatory elements directing expression of said genes.

In particular embodiments, the invention encompasses methods which involve the introduction of exogenous genes and/or the targeting of endogenous genes and their regulatory elements, such as listed below:

1. Genes that Confer Resistance to Pests or Diseases:

Plant disease resistance genes. A plant can be transformed with cloned resistance genes to engineer plants that are resistant to specific pathogen strains. See, e.g., Jones et al., Science 266:789 (1994) (cloning of the tomato Cf-9 gene for resistance to *Cladosporium fulvum*); Martin et al., Science 262:1432 (1993) (tomato Pto gene for resistance to *Pseudomonas syringae* pv. tomato encodes a protein kinase); Mindrinos et al., Cell 78:1089 (1994) (Arabidopsmay be RSP2 gene for resistance to *Pseudomonas syringae*). A plant gene that is upregulated or down regulated during pathogen infection can be engineered for pathogen resistance. See, e.g., Thomazella et al., bioRxiv 064824; doi: doi.org/10.1101/064824 Epub. Jul. 23, 2016 (tomato plants with deletions in the S1DMR6-1 which is normally upregulated during pathogen infection).

Genes conferring resistance to a pest, such as soybean cyst nematode. See e.g., PCT Application WO 96/30517; PCT Application WO 93/19181.

*Bacillus thuringiensis* proteins see, e.g., Geiser et al., Gene 48:109 (1986).

Lectins, see, for example, Van Damme et al., Plant Molec. Biol. 24:25 (1994.

Vitamin-binding protein, such as avidin, see PCT application US93/06487, teaching the use of avidin and avidin homologues as larvicides against insect pests.

Enzyme inhibitors such as protease or proteinase inhibitors or amylase inhibitors. See, e.g., Abe et al., J. Biol. Chem. 262:16793 (1987), Huub et al., Plant Molec. Biol. 21:985 (1993)), Sumitani et al., Biosci. Biotech. Biochem. 57:1243 (1993) and U.S. Pat. No. 5,494,813.

Insect-specific hormones or pheromones such as ecdysteroid or juvenile hormone, a variant thereof, a mimetic based thereon, or an antagonist or agonist thereof. See, for example Hammock et al., Nature 344:458 (1990).

Insect-specific peptides or neuropeptides which, upon expression, disrupts the physiology of the affected pest. For example Regan, J. Biol. Chem. 269:9 (1994) and Pratt et al., Biochem. Biophys. Res. Comm. 163:1243 (1989). See also U.S. Pat. No. 5,266,317.

Insect-specific venom produced in nature by a snake, a wasp, or any other organism. For example, see Pang et al., Gene 116: 165 (1992).

Enzymes responsible for a hyperaccumulation of a monoterpene, a sesquiterpene, a steroid, hydroxamic acid, a phenylpropanoid derivative or another nonprotein molecule with insecticidal activity.

Enzymes involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See PCT application WO93/02197, Kramer et al., Insect Biochem. Molec. Biol. 23:691 (1993) and Kawalleck et al., Plant Molec. Biol. 21 :673 (1993).

Molecules that stimulates signal transduction. For example, see Botella et al., Plant Molec. Biol. 24:757 (1994), and Griess et al., Plant Physiol. 104:1467 (1994).

Viral-invasive proteins or a complex toxin derived therefrom. See Beachy et al., Ann. rev. Phytopathol. 28:451 (1990).

Developmental-arrestive proteins produced in nature by a pathogen or a parasite. See Lamb et al., Bio/Technology 10:1436 (1992) and Toubart et al., Plant J. 2:367 (1992).

A developmental-arrestive protein produced in nature by a plant. For example, Logemann et al., Bio/Technology 10:305 (1992).

In plants, pathogens are often host-specific. For example, some *Fusarium* species will causes tomato wilt but attacks only tomato, and other *Fusarium* species attack only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible or there can be partial resistance against all races of a pathogen, typically controlled by many genes and/or also complete resistance to some races of a pathogen but not to other races. Such resistance is typically controlled by a few genes. Using methods and components of the system, a new tool now exists to induce specific mutations in anticipation hereon. Accordingly, one can analyze the genome of sources of resistance genes, and in plants having desired characteristics or traits, use the method and components of the system to induce the rise of resistance genes. The present systems can do so with more precision than previous mutagenic agents and hence accelerate and improve plant breeding programs.

2. Genes involved in plant diseases, such as those listed in WO 2013046247:

Rice diseases: *Magnaporthe grisea, Cochliobolus miyabeanus, Rhizoctonia solani, Gibberella fujikuroi*; Wheat diseases: *Erysiphe graminis, Fusarium graminearum, F. avenaceum, F. culmorum, Microdochium nivale, Puccinia striiformis, P. graminis, P. recondita, Micronectriella nivale, Typhula* sp., *Ustilago tritici, Tilletia caries, Pseudocercosporella herpotrichoides, Mycosphaerella graminicola, Stagonospora nodorum, Pyrenophora tritici-repentis*; Barley diseases: *Erysiphe graminis, Fusarium graminearum, F. avenaceum, F. culmorum, Microdochium nivale, Puccinia striiformis, P. graminis, P. hordei, Ustilago nuda, Rhynchosporium secalis, Pyrenophora teres, Cochliobolus sativus, Pyrenophora graminea, Rhizoctonia solani*; Maize diseases: *Ustilago maydis, Cochliobolus heterostrophus, Gloeocercospora sorghi, Puccinia polysora, Cercospora zeae-maydis, Rhizoctonia solani;*

Citrus diseases: *Diaporthe citri, Elsinoe fawcetti, Penicillium digitatum, P. italicum, Phytophthora parasitica, Phytophthora citrophthora*; Apple diseases: Monilinia *mali, Valsa ceratosperma, Podosphaera leucotricha, Alternaria alternata* apple pathotype, *Venturia inaequalis, Colletotrichum acutatum, Phytophtora cactorum;*

Pear diseases: *Venturia nashicola*, V. *pirina, Alternaria alternata* Japanese pear pathotype, *Gymnosporangium* haraeanum, Phytophtora *cactorum;*

Peach diseases: *Monilinia fructicola, Cladosporium carpophilum, Phomopsis* sp.;

Grape diseases: *Elsinoe ampelina, Glomerella cingulata, Uninula necator, Phakopsora ampelopsidis, Guignardia bidwellii, Plasmopara viticola;*

Persimmon diseases: *Gloesporium kaki, Cercospora kaki, Mycosphaerela nawae;*

Gourd diseases: *Colletotrichum lagenarium, Sphaerotheca fuliginea, Mycosphaerella melonis, Fusarium oxysporum, Pseudoperonospora cubensis, Phytophthora* sp., *Pythium* sp.;

Tomato diseases: *Alternaria solani, Cladosporium fulvum, Phytophthora infestans; Pseudomonas syringae* pv. Tomato; *Phytophthora capsici; Xanthomonas*

Eggplant diseases: *Phomopsis vexans, Erysiphe cichoracearum;* Brassicaceous vegetable diseases: *Alternaria japonica, Cercosporella brassicae, Plasmodiophora brassicae, Peronospora parasitica;*

Welsh onion diseases: *Puccinia allii, Peronospora* destructor;

Soybean diseases: *Cercospora kikuchii, Elsinoe glycines, Diaporthe phaseolorum* var. *sojae, Septoria glycines, Cercospora sojina, Phakopsora pachyrhizi, Phytophthora sojae, Rhizoctonia solani, Corynespora casiicola, Sclerotinia sclerotiorum;*

Kidney bean diseases: *Colletrichum lindemthianum;*

Peanut diseases: *Cercospora personata, Cercospora arachidicola, Sclerotium rolfsii;*

Pea diseases pea: *Erysiphe pisi;*

Potato diseases: *Alternaria solani, Phytophthora infestans, Phytophthora erythroseptica, Spongospora* subterranean, f. sp. Subterranean;

Strawberry diseases: *Sphaerotheca humuli, Glomerella cingulata;*

Tea diseases: *Exobasidium reticulatum, Elsinoe leucospila, Pestalotiopsis* sp., *Colletotrichum* theae-*sinensis;*

Tobacco diseases: *Alternaria longipes, Erysiphe cichoracearum, Colletotrichum tabacum, Peronospora tabacina, Phytophthora nicotianae;*

Rapeseed diseases: *Sclerotinia sclerotiorum, Rhizoctonia solani;*

Cotton diseases: *Rhizoctonia solani;*

Beet diseases: *Cercospora beticola, Thanatephorus cucumeris, Thanatephorus cucumeris, Aphanomyces cochlioides;*

Rose diseases: *Diplocarpon rosae, Sphaerotheca pannosa, Peronospora sparsa;*

Diseases of *chrysanthemum* and asteraceae: *Bremia lactuca, Septoria chrysanthemi*-indici, *Puccinia horiana;*

Diseases of various plants: *Pythium aphanidermatum, Pythium debarianum, Pythium graminicola, Pythium irregulare, Pythium ultimum, Botrytis cinerea, Sclerotinia sclerotiorum;*

Radish diseases: *Alternaria brassicicola;*

Zoysia diseases: *Sclerotinia homeocarpa, Rhizoctonia solani;*

Banana diseases: *Mycosphaerella fijiensis, Mycosphaerella musicola;*

Sunflower diseases: *Plasmopara halstedii;*

Seed diseases or diseases in the initial stage of growth of various plants caused by *Aspergillus* spp., *Penicillium* spp., *Fusarium* spp., *Gibberella* spp., *Tricoderma* spp., *Thielaviopsis* spp., *Rhizopus* spp., *Mucor* spp., *Corticium* spp., *Rhoma* spp., *Rhizoctonia* spp., *Diplodia* spp., or the like;

Virus diseases of various plants mediated by *Polymixa* spp., *Olpidium* spp., or the like.

3. Examples of Genes that Confer Resistance to Herbicides:

Resistance to herbicides that inhibit the growing point or meristem, such as an imidazolinone or a sulfonylurea, for example, by Lee et al., EMBO J. 7:1241 (1988), and Miki et al., Theor. Appl. Genet. 80:449 (1990), respectively.

Glyphosate tolerance (resistance conferred by, e.g., mutant 5-enolpyruvylshikimate-3-phosphate synthase (EPSPs) genes, aroA genes and glyphosate acetyl transferase (GAT) genes, respectively), or resistance to other phosphono compounds such as by glufosinate (phosphinothricin acetyl transferase (PAT) genes from *Streptomyces* species, including *Streptomyces hygroscopicus* and *Streptomyces viridichromogenes*), and to pyridinoxy or phenoxy proprionic acids and cyclohexones by ACCase inhibitor-encoding genes. See, for example, U.S. Pat. Nos. 4,940,835 and 6,248,876, 4,769,061, EP No. 0 333 033 and U.S. Pat. No. 4,975,374. See also EP No. 0242246, DeGreef et al., Bio/Technology 7:61 (1989), Marshall et al., Theor. Appl. Genet. 83:435 (1992), WO 2005012515 to Castle et. al. and WO 2005107437.

Resistance to herbicides that inhibit photosynthesis, such as a triazine (psbA and gs+ genes) or a benzonitrile (nitrilase gene), and glutathione S-transferase in Przibila et al., Plant Cell 3:169 (1991), U.S. Pat. No. 4,810,648, and Hayes et al., Biochem. J. 285: 173 (1992).

Genes encoding enzymes detoxifying the herbicide or a mutant glutamine synthase enzyme that is resistant to inhibition, e.g. in U.S. patent application Ser. No. 11/760,602. Or a detoxifying enzyme is an enzyme encoding a phosphinothricin acetyltransferase (such as the bar or pat protein from *Streptomyces* species). Phosphinothricin acetyltransferases are for example described in U.S. Pat. Nos. 5,561,236; 5,648,477; 5,646,024; 5,273,894; 5,637,489; 5,276,268; 5,739,082; 5,908,810 and 7,112,665.

Hydroxyphenylpyruvatedioxygenases (HPPD) inhibitors, ie naturally occuring HPPD resistant enzymes, or genes encoding a mutated or chimeric HPPD enzyme as described in WO 96/38567, WO 99/24585, and WO 99/24586, WO 2009/144079, WO 2002/046387, or U.S. Pat. No. 6,768,044.

Examples of Genes Involved in Abiotic Stress Tolerance:

Transgene capable of reducing the expression and/or the activity of poly(ADP-ribose) polymerase (PARP) gene in the plant cells or plants as described in WO 00/04173 or, WO/2006/045633.

Transgenes capable of reducing the expression and/or the activity of the PARG encoding genes of the plants or plants cells, as described e.g. in WO 2004/090140.

Transgenes coding for a plant-functional enzyme of the nicotineamide adenine dinucleotide salvage synthesis pathway including nicotinamidase, nicotinate phosphoribosyltransferase, nicotinic acid mononucleotide adenyl transferase, nicotinamide adenine dinucleotide synthetase or nicotine amide phosphorybosyltransferase as described e.g. in EP 04077624.7, WO 2006/133827, PCT/EP07/002,433, EP 1999263, or WO 2007/107326.

Enzymes involved in carbohydrate biosynthesis include those described in e.g. EP 0571427, WO 95/04826, EP 0719338, WO 96/15248, WO 96/19581, WO 96/27674, WO 97/11188, WO 97/26362, WO 97/32985, WO 97/42328, WO 97/44472, WO 97/45545, WO 98/27212, WO 98/40503, WO99/58688, WO 99/58690, WO 99/58654, WO 00/08184, WO 00/08185, WO 00/08175, WO 00/28052, WO 00/77229, WO 01/12782, WO 01/12826, WO 02/101059, WO 03/071860, WO 2004/056999, WO 2005/030942, WO 2005/030941, WO 2005/095632, WO 2005/095617, WO 2005/095619, WO 2005/095618, WO 2005/123927, WO 2006/018319, WO 2006/103107, WO 2006/108702, WO 2007/009823, WO 00/22140, WO 2006/063862, WO 2006/072603, WO 02/034923, EP 06090134.5, EP 06090228.5, EP 06090227.7, EP 07090007.1, EP 07090009.7, WO 01/14569, WO 02/79410, WO 03/33540, WO 2004/078983, WO 01/19975, WO 95/26407, WO 96/34968, WO 98/20145, WO 99/12950, WO 99/66050, WO 99/53072, U.S. Pat. No. 6,734,341, WO 00/11192, WO 98/22604, WO 98/32326, WO 01/98509, WO 01/98509, WO 2005/002359, U.S. Pat. Nos. 5,824,790, 6,013,861, WO 94/04693, WO 94/09144, WO 94/11520, WO 95/35026 or WO 97/20936 or enzymes involved in the production of polyfructose, especially of the inulin and levan-type, as disclosed in EP 0663956, WO 96/01904, WO 96/21023, WO 98/39460, and WO 99/24593, the production of alpha-1,4-glucans as disclosed in WO 95/31553, US 2002031826, U.S. Pat. Nos. 6,284,479, 5,712,107, WO 97/47806, WO 97/47807, WO 97/47808 and WO 00/14249, the production of alpha-1,6 branched alpha-1,4-glucans, as disclosed in WO 00/73422, the production of alternan, as disclosed in e.g. WO 00/47727, WO 00/73422, EP 06077301.7, U.S. Pat. No. 5,908,975 and EP 0728213, the production of hyaluronan, as for example disclosed in WO 2006/032538, WO 2007/039314, WO 2007/039315, WO 2007/039316, JP 2006304779, and WO 2005/012529.

Genes that improve drought resistance. For example, WO 2013122472 discloses that the absence or reduced level of functional Ubiquitin Protein Ligase protein (UPL) protein, more specifically, UPL3, leads to a decreased need for water or improved resistance to drought of said plant. Other examples of transgenic plants with increased drought tolerance are disclosed in, for example, US 2009/0144850, US 2007/0266453, and WO 2002/083911. US2009/0144850 describes a plant displaying a drought tolerance phenotype due to altered expression of a DRO2 nucleic acid. US 2007/0266453 describes a plant displaying a drought tolerance phenotype due to altered expression of a DR03 nucleic acid and WO 2002/08391 describes a plant having an increased tolerance to drought stress due to a reduced activity of an ABC transporter which is expressed in guard cells. Another example is the work by Kasuga and co-authors (1999), who describe that overexpression of cDNA encoding DREB1 A in transgenic plants activated the expression of many stress tolerance genes under normal growing conditions and resulted in improved tolerance to drought, salt loading, and freezing. However, the expression of DREB1A also resulted in severe growth retardation under normal growing conditions (Kasuga (1999) Nat Biotechnol 17(3) 287-291).

In further particular embodiments, crop plants can be improved by influencing specific plant traits. For example, by developing pesticide-resistant plants, improving disease resistance in plants, improving plant insect and nematode resistance, improving plant resistance against parasitic weeds, improving plant drought tolerance, improving plant nutritional value, improving plant stress tolerance, avoiding self-pollination, plant forage digestibility biomass, grain yield etc. A few specific non-limiting examples are provided hereinbelow.

In addition to targeted mutation of single genes, systems can be designed to allow targeted mutation of multiple genes, deletion of chromosomal fragment, site-specific integration of transgene, site-directed mutagenesis in vivo, and precise gene replacement or allele swapping in plants. Therefore, the methods described herein have broad applications in gene discovery and validation, mutational and cisgenic breeding, and hybrid breeding. These applications facilitate the production of a new generation of genetically modified crops with various improved agronomic traits such as herbicide resistance, disease resistance, abiotic stress tolerance, high yield, and superior quality.

Creating Male Sterile Plants

Hybrid plants typically have advantageous agronomic traits compared to inbred plants. However, for self-pollinating plants, the generation of hybrids can be challenging. In different plant types, genes have been identified which are important for plant fertility, more particularly male fertility. For instance, in maize, at least two genes have been identified which are important in fertility (Amitabh Mohanty International Conference on New Plant Breeding Molecular Technologies Technology Development And Regulation, Oct. 9-10, 2014, Jaipur, India; Svitashev et al. Plant Physiol. 2015 October; 169(2):931-45; Djukanovic et al. Plant J. 2013 December; 76(5):888-99). The methods provided herein can be used to target genes required for male fertility so as to generate male sterile plants which can easily be crossed to generate hybrids. In particular embodiments, the system provided herein is used for targeted mutagenesis of the cytochrome P450-like gene (MS26) or the meganuclease gene (MS45) thereby conferring male sterility to the maize plant. Maize plants, which are as such genetically altered, can be used in hybrid breeding programs.

Increasing the Fertility Stage in Plants

In particular embodiments, the systems and methods provided herein are used to prolong the fertility stage of a plant such as of a rice plant. For instance, a rice fertility stage gene such as Ehd3 can be targeted in order to generate a mutation in the gene and plantlets can be selected for a prolonged regeneration plant fertility stage (as described in CN 104004782)

Generating Genetic Variation in a Crop of Interest

The availability of wild germplasm and genetic variations in crop plants is the key to crop improvement programs, but the available diversity in germplasms from crop plants is limited. The present invention envisages methods for generating a diversity of genetic variations in a germplasm of interest. In this application of the system a library of guide RNAs targeting different locations in the plant genome is provided and is introduced into plant cells together with the Cas effector protein. In this way a collection of genome-scale point mutations and gene knock-outs can be generated. In particular embodiments, the methods comprise generating a plant part or plant from the cells so obtained and screening the cells for a trait of interest. The target genes can include both coding and non-coding regions. In particular embodiments, the trait is stress tolerance and the method is a method for the generation of stress-tolerant crop varieties Regulating Fruit-Ripening Ripening is a normal phase in the maturation process of fruits and vegetables. Only a few days after it starts it renders a fruit or vegetable inedible. This process brings significant losses to both farmers and consumers. In particular embodiments, the methods of the present invention are used to reduce ethylene production. This is ensured by ensuring one or more of the following: a. Suppression of ACC synthase gene expression. ACC (1-aminocyclopropane-1-carboxylic acid) synthase is the enzyme responsible for the conversion of S-adenosylmethionine (SAM) to ACC; the second to the last step in ethylene biosynthesis. Enzyme expression is hindered when an antisense ("mirror-image") or truncated copy of the synthase gene is inserted into the plant's genome; b. Insertion of the ACC deaminase gene. The gene coding for the enzyme is obtained from *Pseudomonas chlororaphis*, a common nonpathogenic soil bacterium. It converts ACC to a different compound thereby reducing the amount of ACC available for ethylene production; c. Insertion of the SAM hydrolase gene. This approach is similar to ACC deaminase wherein ethylene production is hindered when the amount of its precursor metabolite is reduced; in this case SAM is converted to homoserine. The gene coding for the enzyme is obtained from *E. coli* T3 bacteriophage and d. Suppression of ACC oxidase gene expression. ACC oxidase is the enzyme which catalyzes the oxidation of ACC to ethylene, the last step in the ethylene biosynthetic pathway. Using the methods described herein, down regulation of the ACC oxidase gene results in the suppression of ethylene production, thereby delaying fruit ripening. In particular embodiments, additionally or alternatively to the modifications described above, the methods described herein are used to modify ethylene receptors, so as to interfere with ethylene signals obtained by the fruit. In particular embodiments, expression of the ETR1 gene, encoding an ethylene binding protein is modified, more particularly suppressed. In particular embodiments, additionally or alternatively to the modifications described above, the methods described herein are used to modify expression of the gene encoding Polygalacturonase (PG), which is the enzyme responsible for the breakdown of pectin, the substance that maintains the integrity of plant cell walls. Pectin breakdown occurs at the start of the ripening process resulting in the softening of the fruit. Accordingly, in particular embodiments, the methods described herein are used to introduce a mutation in the PG gene or to suppress activation of the PG gene in order to reduce the amount of PG enzyme produced thereby delaying pectin degradation.

Thus in particular embodiments, the methods comprise the use of the system to ensure one or more modifications of the genome of a plant cell such as described above, and regenerating a plant therefrom. In particular embodiments, the plant is a tomato plant.

Increasing Storage Life of Plants

In particular embodiments, the methods of the present invention are used to modify genes involved in the production of compounds which affect storage life of the plant or plant part. More particularly, the modification is in a gene that prevents the accumulation of reducing sugars in potato tubers. Upon high-temperature processing, these reducing sugars react with free amino acids, resulting in brown, bitter-tasting products and elevated levels of acrylamide, which is a potential carcinogen. In particular embodiments, the methods provided herein are used to reduce or inhibit expression of the vacuolar invertase gene (VInv), which encodes a protein that breaks down sucrose to glucose and fructose (Clasen et al. DOI: 10.1111/pbi.12370).

The Use of the System to Ensure a Value Added Trait

In particular embodiments the system is used to produce nutritionally improved agricultural crops. In particular embodiments, the methods provided herein are adapted to generate "functional foods", i.e. a modified food or food ingredient that may provide a health benefit beyond the traditional nutrients it contains and or "nutraceutical", i.e. substances that may be considered a food or part of a food and provides health benefits, including the prevention and treatment of disease. In particular embodiments, the nutraceutical is useful in the prevention and/or treatment of one or more of cancer, diabetes, cardiovascular disease, and hypertension.

Examples of nutritionally improved crops include (Newell-McGloughlin, Plant Physiology, July 2008, Vol. 147, pp. 939-953):

Modified protein quality, content and/or amino acid composition, such as have been described for Bahiagrass (Luciani et al. 2005, Florida Genetics Conference Poster), Canola (Roesler et al., 1997, Plant Physiol 113 75-81), Maize (Cromwell et al, 1967, 1969 J Anim Sci 26 1325-

1331, O'Quin et al. 2000 J Anim Sci 78 2144-2149, Yang et al. 2002, Transgenic Res 11 11-20, Young et al. 2004, Plant J 38 910-922), Potato (Yu J and Ao, 1997 Acta Bot Sin 39 329-334; Chakraborty et al. 2000, Proc Natl Acad Sci USA 97 3724-3729; Li et al. 2001) Chin Sci Bull 46 482-484, Rice (Katsube et al. 1999, Plant Physiol 120 1063-1074), Soybean (Dinkins et al. 2001, Rapp 2002, In Vitro Cell Dev Biol Plant 37 742-747), Sweet Potato (Egnin and Prakash 1997, In Vitro Cell Dev Biol 33 52A).

Essential amino acid content, such as has been described for Canola (Falco et al. 1995, Bio/Technology 13 577-582), Lupin (White et al. 2001, J Sci Food Agric 81 147-154), Maize (Lai and Messing, 2002, Agbios 2008 GM crop database (Mar. 11, 2008)), Potato (Zeh et al. 2001, Plant Physiol 127 792-802), Sorghum (Zhao et al. 2003, Kluwer Academic Publishers, Dordrecht, The Netherlands, pp 413-416), Soybean (Falco et al. 1995 Bio/Technology 13 577-582; Galili et al. 2002 Crit Rev Plant Sci 21 167-204).

Oils and Fatty acids such as for Canola (Dehesh et al. (1996) Plant J 9 167-172; Del Vecchio (1996) INFORM International News on Fats, Oils and Related Materials 7 230-243; Roesler et al. (1997) Plant Physiol 113 75-81; Froman and Ursin (2002, 2003) Abstracts of Papers of the American Chemical Society 223 U35; James et al. (2003) Am J Clin Nutr 77 1140-1145 [PubMed]; Agbios (2008, above); coton (Chapman et al. (2001). J Am Oil Chem Soc 78 941-947; Liu et al. (2002) J Am Coll Nutr 21 205S-211S [PubMed]; O'Neill (2007) Australian Life Scientist. www.biotechnews com. au/index. php/id; 866694817; fp; 4; fpid; 2 (Jun. 17, 2008), Linseed (Abbadi et al., 2004, Plant Cell 16: 2734-2748), Maize (Young et al., 2004, Plant J 38 910-922), oil palm (Jalani et al. 1997, J Am Oil Chem Soc 74 1451-1455; Parveez, 2003, AgBiotechNet 113 1-8), Rice (Anai et al., 2003, Plant Cell Rep 21 988-992), Soybean (Reddy and Thomas, 1996, Nat Biotechnol 14 639-642; Kinney and Kwolton, 1998, Blackie Academic and Professional, London, pp 193-213), Sunflower (Arcadia, Biosciences 2008)

Carbohydrates, such as Fructans described for Chicory (Smeekens (1997) Trends Plant Sci 2 286-287, Sprenger et al. (1997) FEBS Lett 400 355-358, Sevenier et al. (1998) Nat Biotechnol 16 843-846), Maize (Caimi et al. (1996) Plant Physiol 110 355-363), Potato (Hellwege et al., 1997 Plant J 12 1057-1065), Sugar Beet (Smeekens et al. 1997, above), Inulin, such as described for Potato (Hellewege et al. 2000, Proc Natl Acad Sci USA 97 8699-8704), Starch, such as described for Rice (Schwall et al. (2000) Nat Biotechnol 18 551-554, Chiang et al. (2005) Mol Breed 15 125-143), Vitamins and carotenoids, such as described for Canola (Shintani and DellaPenna (1998) Science 282 2098-2100), Maize (Rocheford et al. (2002). J Am Coll Nutr 21 191S-198S, Cahoon et al. (2003) Nat Biotechnol 21 1082-1087, Chen et al. (2003) Proc Natl Acad Sci USA 100 3525-3530), Mustardseed (Shewmaker et al. (1999) Plant J 20 401-412, Potato (Ducreux et al., 2005, J Exp Bot 56 81-89), Rice (Ye et al. (2000) Science 287 303-305, Strawberry (Agius et al. (2003), Nat Biotechnol 21 177-181), Tomato (Rosati et al. (2000) Plant J 24 413-419, Fraser et al. (2001) J Sci Food Agric 81 822-827, Mehta et al. (2002) Nat Biotechnol 20 613-618, Diaz de la Garza et al. (2004) Proc Natl Acad Sci USA 101 13720-13725, Enfissi et al. (2005) Plant Biotechnol J 3 17-27, DellaPenna (2007) Proc Natl Acad Sci USA 104 3675-3676.

Functional secondary metabolites, such as described for Apple (stilbenes, Szankowski et al. (2003) Plant Cell Rep 22: 141-149), Alfalfa (resveratrol, Hipskind and Paiva (2000) Mol Plant Microbe Interact 13 551-562), Kiwi (resveratrol, Kobayashi et al. (2000) Plant Cell Rep 19 904-910), Maize and Soybean (flavonoids, Yu et al. (2000) Plant Physiol 124 781-794), Potato (anthocyanin and alkaloid glycoside, Lukaszewicz et al. (2004) J Agric Food Chem 52 1526-1533), Rice (flavonoids & resveratrol, Stark-Lorenzen et al. (1997) Plant Cell Rep 16 668-673, Shin et al. (2006) Plant Biotechnol J 4 303-315), Tomato (+resveratrol, chlorogenic acid, flavonoids, stilbene; Rosati et al. (2000) above, Muir et al. (2001) Nature 19 470-474, Niggeweg et al. (2004) Nat Biotechnol 22 746-754, Giovinazzo et al. (2005) Plant Biotechnol J 3 57-69), wheat (caffeic and ferulic acids, resveratrol; United Press International (2002)); and Mineral availabilities such as described for Alfalfa (phytase, Austin-Phillips et al. (1999) www.molecularfarming.com/nonmedical.html), Lettuce (iron, Goto et al. (2000) Theor Appl Genet 100 658-664), Rice (iron, Lucca et al. (2002) J Am Coll Nutr 21 184S-190S), Maize, Soybean and Wheat (phytase, Drakakaki et al. (2005) Plant Mol Biol 59 869-880, Denbow et al. (1998) Poult Sci 77 878-881, Brinch-Pedersen et al. (2000) Mol Breed 6 195-206).

In particular embodiments, the value-added trait is related to the envisaged health benefits of the compounds present in the plant. For instance, in particular embodiments, the value-added crop is obtained by applying the methods of the invention to ensure the modification of or induce/increase the synthesis of one or more of the following compounds:

Carotenoids, such as α-Carotene present in carrots which Neutralizes free radicals that may cause damage to cells or β-Carotene present in various fruits and vegetables which neutralizes free radicals.

Lutein present in green vegetables which contributes to maintenance of healthy vision.

Lycopene present in tomato and tomato products, which is believed to reduce the risk of prostate cancer.

Zeaxanthin, present in citrus and maize, which contributes to maintenance of healthy vision.

Dietary fiber such as insoluble fiber present in wheat bran which may reduce the risk of breast and/or colon cancer and β-Glucan present in oat, soluble fiber present in Psylium and whole cereal grains which may reduce the risk of cardiovascular disease (CVD).

Fatty acids, such as ω-3 fatty acids which may reduce the risk of CVD and improve mental and visual functions, Conjugated linoleic acid, which may improve body composition, may decrease risk of certain cancers and GLA which may reduce inflammation risk of cancer and CVD, may improve body composition.

Flavonoids such as hydroxycinnamates, present in wheat which have Antioxidant-like activities, may reduce risk of degenerative diseases, flavonols, catechins and tannins present in fruits and vegetables which neutralize free radicals and may reduce risk of cancer.

Glucosinolates, indoles, isothiocyanates, such as Sulforaphane, present in Cruciferous vegetables (broccoli, kale), horseradish, which neutralize free radicals, may reduce risk of cancer.

Phenolics, such as stilbenes present in grape which may reduce risk of degenerative diseases, heart disease, and cancer, may have longevity effect and caffeic acid and ferulic acid present in vegetables and citrus which have Antioxidant-like activities, may reduce risk of degenerative diseases, heart disease, and eye disease, and epicatechin present in cacao which has Antioxidant-like activities, may reduce risk of degenerative diseases and heart disease.

Plant stanols/sterols present in maize, soy, wheat and wooden oils which May reduce risk of coronary heart disease by lowering blood cholesterol levels.

Fructans, inulins, fructo-oligosaccharides present in Jerusalem artichoke, shallot, onion powder which may improve gastrointestinal health.

Saponins present in soybean, which may lower LDL cholesterol.

Soybean protein present in soybean which may reduce risk of heart disease.

Phytoestrogens such as isoflavones present in soybean which May reduce menopause symptoms, such as hot flashes, may reduce osteoporosis and CVD and lignans present in flax, rye and vegetables, which May protect against heart disease and some cancers, may lower LDL cholesterol, total cholesterol.

Sulfides and thiols such as diallyl sulphide present in onion, garlic, olive, leek and scallon and Allyl methyl trisulfide, dithiolthiones present in cruciferous vegetables which may lower LDL cholesterol, helps to maintain healthy immune system.

Tannins, such as proanthocyanidins, present in cranberry, cocoa, which may improve urinary tract health, may reduce risk of CVD and high blood pressure.

In addition, the methods of the present invention also envisage modifying protein/starch functionality, shelf life, taste/aesthetics, fiber quality, and allergen, antinutrient, and toxin reduction traits.

Accordingly, the invention encompasses methods for producing plants with nutritional added value, said methods comprising introducing into a plant cell a gene encoding an enzyme involved in the production of a component of added nutritional value using the system as described herein and regenerating a plant from said plant cell, said plant characterized in an increase expression of said component of added nutritional value. In particular embodiments, the system is used to modify the endogenous synthesis of these compounds indirectly, e.g. by modifying one or more transcription factors that controls the metabolism of this compound. Methods for introducing a gene of interest into a plant cell and/or modifying an endogenous gene using the system are described herein above.

Some specific examples of modifications in plants that have been modified to confer value-added traits are: plants with modified fatty acid metabolism, for example, by transforming a plant with an antisense gene of stearyl-ACP desaturase to increase stearic acid content of the plant. See Knultzon et al., Proc. Natl. Acad. Sci. U.S.A. 89:2624 (1992). Another example involves decreasing phytate content, for example by cloning and then reintroducing DNA associated with the single allele which may be responsible for maize mutants characterized by low levels of phytic acid. See Raboy et al, Maydica 35:383 (1990).

Similarly, expression of the maize (*Zea mays*) Tfs C1 and R, which which regulate the production of flavonoids in maize aleurone layers under the control of a strong promoter, resulted in a high accumulation rate of anthocyanins in *Arabidopsis* (*Arabidopsis thaliana*), presumably by activating the entire pathway (Bruce et al., 2000, Plant Cell 12:65-80). DellaPenna (Welsch et al., 2007 Annu Rev Plant Biol 57: 711-738) found that Tf RAP2.2 and its interacting partner SINAT2 increased carotenogenesis in *Arabidopsis* leaves. Expressing the Tf Dofl induced the up-regulation of genes encoding enzymes for carbon skeleton production, a marked increase of amino acid content, and a reduction of the Glc level in transgenic *Arabidopsis* (Yanagisawa, 2004 Plant Cell Physiol 45: 386-391), and the DOF Tf AtDof1.1 (OBP2) up-regulated all steps in the glucosinolate biosynthetic pathway in *Arabidopsis* (Skirycz et al., 2006 Plant J 47: 10-24).

Reducing Allergen in Plants

In particular embodiments the methods provided herein are used to generate plants with a reduced level of allergens, making them safer for the consumer. In particular embodiments, the methods comprise modifying expression of one or more genes responsible for the production of plant allergens. For instance, in particular embodiments, the methods comprise down-regulating expression of a Lol p5 gene in a plant cell, such as a ryegrass plant cell and regenerating a plant therefrom so as to reduce allergenicity of the pollen of said plant (Bhalla et al. 1999, Proc. Natl. Acad. Sci. USA Vol. 96: 11676-11680).

Peanut allergies and allergies to legumes generally are a real and serious health concern. The Cas-associated transposase systems of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3):222).

Screening Methods for Endogenous Genes of Interest

The methods provided herein further allow the identification of genes of value encoding enzymes involved in the production of a component of added nutritional value or generally genes affecting agronomic traits of interest, across species, phyla, and plant kingdom. By selectively targeting e.g. genes encoding enzymes of metabolic pathways in plants using the system as described herein, the genes responsible for certain nutritional aspects of a plant can be identified. Similarly, by selectively targeting genes which may affect a desirable agronomic trait, the relevant genes can be identified. Accordingly, the present invention encompasses screening methods for genes encoding enzymes involved in the production of compounds with a particular nutritional value and/or agronomic traits.

Further Applications of the System in Plants and Yeasts

Biofuel Production

The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the system as described herein are used to alter the properties of the cell wall in order to facilitate access by key hydrolyzing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488). More particularly, the methods disclosed herein are used to generate mutations in homologs to Cas1L to reduce polysaccharide acetylation.

Modifying Yeast for Biofuel Production

In particular embodiments, the Cas enzyme provided herein is used for bioethanol production by recombinant micro-organisms. For instance, Cas can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the system is used to introduce foreign genes required for biofuel production into micro-organisms and/or to modify endogenous genes why may interfere with the biofuel synthesis. More particularly the methods involve introducing into a micro-organism such as a yeast one or more nucleotide sequence encoding enzymes involved in the conversion of pyruvate to ethanol or another product of interest. In particular embodiments the methods ensure the introduction of one or more enzymes which allows the micro-organism to degrade cellulose, such as a cellulase. In yet further embodiments, the Cas CRISPR complex is used to modify endogenous metabolic pathways which compete with the biofuel production pathway.

Accordingly, in more particular embodiments, the methods described herein are used to modify a micro-organism as follows:

to introduce at least one heterologous nucleic acid or increase expression of at least one endogenous nucleic acid encoding a plant cell wall degrading enzyme, such that said micro-organism is capable of expressing said nucleic acid and of producing and secreting said plant cell wall degrading enzyme;

to introduce at least one heterologous nucleic acid or increase expression of at least one endogenous nucleic acid encoding an enzyme that converts pyruvate to acetaldehyde optionally combined with at least one heterologous nucleic acid encoding an enzyme that converts acetaldehyde to ethanol such that said host cell is capable of expressing said nucleic acid; and/or to modify at least one nucleic acid encoding for an enzyme in a metabolic pathway in said host cell, wherein said pathway produces a metabolite other than acetaldehyde from pyruvate or ethanol from acetaldehyde, and wherein said modification results in a reduced production of said metabolite, or to introduce at least one nucleic acid encoding for an inhibitor of said enzyme.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

According to particular embodiments of the invention, the system is used to generate lipid-rich diatoms which are useful in biofuel production.

In particular embodiments it is envisaged to specifically modify genes that are involved in the modification of the quantity of lipids and/or the quality of the lipids produced by the algal cell. Examples of genes encoding enzymes involved in the pathways of fatty acid synthesis can encode proteins having for instance acetyl-CoA carboxylase, fatty acid synthase, 3-ketoacyl acyl-carrier protein synthase III, glycerol-3-phospate deshydrogenase (G3PDH), Enoyl-acyl carrier protein reductase (Enoyl-ACP-reductase), glycerol-3-phosphate acyltransferase, lysophosphatidic acyl transferase or diacylglycerol acyltransferase, phospholipid: diacylglycerol acyltransferase, phoshatidate phosphatase, fatty acid thioesterase such as palmitoyi protein thioesterase, or malic enzyme activities. In further embodiments it is envisaged to generate diatoms that have increased lipid accumulation. This can be achieved by targeting genes that decrease lipid catabolisation. Of particular interest for use in the methods of the present invention are genes involved in the activation of both triacylglycerol and free fatty acids, as well as genes directly involved in β-oxidation of fatty acids, such as acyl-CoA synthetase, 3-ketoacyl-CoA thiolase, acyl-CoA oxidase activity and phosphoglucomutase. The system and methods described herein can be used to specifically activate such genes in diatoms as to increase their lipid content.

Organisms such as microalgae are widely used for synthetic biology. Stovicek et al. (Metab. Eng. Comm., 2015; 2:13 describes genome editing of industrial yeast, for example, *Saccharomyces cerevisae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2μ-based vector locations. The authors also showed that gene disruption efficiency could be improved by optimization of the levels of Cas9 and gRNA expression. Hlavová et al. (Biotechnol. Adv. 2015) discusses development of species or strains of microalgae using techniques such as CRISPR to target nuclear and chloroplast genes for insertional mutagenesis and screening. The methods of Stovicek and Hlavová may be applied to the Cas effector protein system of the present invention.

U.S. Pat. No. 8,945,839 describes a method for engineering Micro-Algae (*Chlamydomonas reinhardtii* cells) species) using Cas9. Using similar tools, the methods of the system described herein can be applied on *Chlamydomonas* species and other algae. In particular embodiments, Cas and guide RNA are introduced in algae expressed using a vector that expresses Cas under the control of a constitutive promoter such as Hsp70A-Rbc S2 or Beta2-tubulin. Guide RNA will be delivered using a vector containing T7 promoter. Alternatively, Cas mRNA and in vitro transcribed guide RNA can be delivered to algal cells. Electroporation protocol follows standard recommended protocol from the GeneArt *Chlamydomonas* Engineering kit.

Generation of Improved Xylose or Cellobiose Utilizing Yeasts Strains

In particular embodiments, the systems disclosed herein may be applied to select for improved xylose or cellobiose utilizing yeast strains. Error-prone PCR can be used to amplify one (or more) genes involved in the xylose utilization or cellobiose utilization pathways. Examples of genes involved in xylose utilization pathways and cellobiose utilization pathways may include, without limitation, those described in Ha, S. J., et al. (2011) Proc. Natl. Acad. Sci. USA 108(2):504-9 and Galazka, J. M., et al. (2010) Science 330(6000):84-6. Resulting libraries of double-stranded DNA molecules, each comprising a random mutation in such a selected gene could be co-transformed with the components of the system into a yeast strain (for instance S288C) and strains can be selected with enhanced xylose or cellobiose utilization capacity, as described in WO2015138855.

Generation of Improved Yeasts Strains for Use in Isoprenoid Biosynthesis

Tadas Jakočiūnas et al. described the successful application of a multiplex CRISPR/Cas9 system for genome engineering of up to 5 different genomic loci in one transformation step in baker's yeast *Saccharomyces cerevisiae* (Metabolic Engineering Volume 28, March 2015, Pages 213-222) resulting in strains with high mevalonate production, a key intermediate for the industrially important isoprenoid biosynthesis pathway. In particular embodiments, the system may be applied in a multiplex genome engineering method as described herein for identifying additional high producing yeast strains for use in isoprenoid synthesis.

Generation of Lactic Acid Producing Yeasts Strains

In another embodiment, successful application of a multiplex system is encompassed. In analogy with Vratislav Stovicek et al. (Metabolic Engineering Communications, Volume 2, December 2015, Pages 13-22), improved lactic acid-producing strains can be designed and obtained in a single transformation event. In a particular embodiment, the system is used for simultaneously inserting the heterologous lactate dehydrogenase gene and disruption of two endogenous genes PDC1 and PDC5 genes.

Further Applications in Plants

In particular embodiments, the system, and preferably the system described herein, can be used for visualization of genetic element dynamics. For example, CRISPR imaging can visualize either repetitive or non-repetitive genomic sequences, report telomere length change and telomere movements and monitor the dynamics of gene loci throughout the cell cycle (Chen et al., Cell, 2013). These methods may also be applied to plants.

Other applications of the system, and preferably the system described herein, is the targeted gene disruption positive-selection screening in vitro and in vivo (Malina et al., Genes and Development, 2013). These methods may also be applied to plants.

In particular embodiments, fusion of inactive Cas endonucleases with histone-modifying enzymes can introduce custom changes in the complex epigenome (Rusk et al., Nature Methods, 2014). These methods may also be applied to plants.

In particular embodiments, the system, and preferably the system described herein, can be used to purify a specific portion of the chromatin and identify the associated proteins, thus elucidating their regulatory roles in transcription (Waldrip et al., Epigenetics, 2014). These methods may also be applied to plants.

In particular embodiments, present invention can be used as a therapy for virus removal in plant systems as it is able to cleave both viral DNA and RNA. Previous studies in human systems have demonstrated the success of utilizing CRISPR in targeting the single strand RNA virus, hepatitis C (A. Price, et al., Proc. Natl. Acad. Sci, 2015) as well as the double stranded DNA virus, hepatitis B (V. Ramanan, et al., Sci. Rep, 2015). These methods may also be adapted for using the system in plants.

In particular embodiments, present invention could be used to alter genome complexity. In further particular embodiment, the system, and preferably the system described herein, can be used to disrupt or alter chromosome number and generate haploid plants, which only contain chromosomes from one parent. Such plants can be induced to undergo chromosome duplication and converted into diploid plants containing only homozygous alleles (Karimi-Ashtiyani et al., PNAS, 2015; Anton et al., Nucleus, 2014). These methods may also be applied to plants.

In particular embodiments, the system described herein, can be used for self-cleavage. In these embodiments, the promotor of the Cas enzyme and gRNA can be a constitutive promotor and a second gRNA is introduced in the same transformation cassette, but controlled by an inducible promoter. This second gRNA can be designated to induce site-specific cleavage in the Cas gene in order to create a non-functional Cas. In a further particular embodiment, the second gRNA induces cleavage on both ends of the transformation cassette, resulting in the removal of the cassette from the host genome. This system offers a controlled duration of cellular exposure to the Cas enzyme and further minimizes off-target editing. Furthermore, cleavage of both ends of a CRISPR/Cas cassette can be used to generate transgene-free T0 plants with bi-allelic mutations (as described for Cas9 e.g. Moore et al., Nucleic Acids Research, 2014; Schaeffer et al., Plant Science, 2015). The methods of Moore et al. may be applied to the systems described herein.

Sugano et al. (Plant Cell Physiol. 2014 March; 55(3):475-81. doi: 10.1093/pcp/pcu014. Epub 2014 Jan. 18) reports the application of CRISPR-Cas9 to targeted mutagenesis in the liverwort *Marchantia polymorpha* L., which has emerged as a model species for studying land plant evolution. The U6 promoter of *M. polymorpha* was identified and cloned to express the gRNA. The target sequence of the gRNA was designed to disrupt the gene encoding auxin response factor 1 (ARF1) in *M. polymorpha*. Using *Agrobacterium*-mediated transformation, Sugano et al. isolated stable mutants in the gametophyte generation of *M. polymorpha*. CRISPR-Cas9-based site-directed mutagenesis in vivo was achieved using either the Cauliflower mosaic virus 35S or *M. polymorpha* EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR-Cas9-based targeted mutagenesis. The methods of Sugano et al. may be applied to the Cas effector protein system of the present invention.

Kabadi et al. (Nucleic Acids Res. 2014 Oct. 29; 42(19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The methods of Kabadi et al. may be applied to the Cas effector protein system of the present invention.

Ling et al. (BMC Plant Biology 2014, 14:327) developed a CRISPR-Cas9 binary vector set based on the pGreen or pCAMBIA backbone, as well as a gRNA. This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation. (guide RNA)module vector set, as a toolkit for multiplex genome editing in plants. The toolbox of Lin et al. may be applied to the Cas effector protein system of the present invention.

Protocols for targeted plant genome editing via CRISPR-Cas are also available based on those disclosed for the CRISPR-Cas9 system in volume 1284 of the series Methods in Molecular Biology pp 239-255 10 Feb. 2015. A detailed procedure to design, construct, and evaluate dual gRNAs for plant codon optimized Cas9 (pcoCas9) mediated genome editing using *Arabidopsis thaliana* and *Nicotiana benthamiana* protoplasts as model cellular systems are described. Strategies to apply the CRISPR-Cas9 system to generating targeted genome modifications in whole plants are also discussed. The protocols described in the chapter may be applied to the Cas effector protein system of the present invention.

Ma et al. (Mol Plant. 2015 Aug. 3; 8(8):1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in T0 rice and T1*Arabidopsis* plants by simultaneous targeting of multiple (up to eight) members of a gene family, multiple genes in a biosynthetic pathway, or multiple sites in a single gene. The methods of Ma et al. may be applied to the Cas effector protein system of the present invention.

Lowder et al. (Plant Physiol. 2015 Aug. 21. pii: pp. 00636.2015) also developed a CRISPR-Cas9 toolbox enables multiplex genome editing and transcriptional regulation of expressed, silenced or non-coding genes in plants. This toolbox provides researchers with a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modern plant biotechnology, genetics, molecular biology and physiology. As such, Applicants developed a method for the assembly of Cas (WT, nickase or dCas) and gRNA(s) into a T-DNA destination-vector of interest. The assembly method is based on both Golden Gate assembly and MultiSite Gateway recombination. Three modules are required for assembly. The first module is a Cas entry vector, which contains promoterless Cas or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas expression. The toolbox of Lowder et al. may be applied to the Cas effector protein system of the present invention.

Wang et al. (bioRxiv 051342; doi: doi.org/10.1101/051342; Epub. May 12, 2016) demonstrate editing of homoeologous copies of four genes affecting important agronomic traits in hexaploid wheat using a multiplexed gene editing construct with several gRNA-tRNA units under the control of a single promoter.

In an advantageous embodiment, the plant may be a tree. The present invention may also utilize the herein disclosed system for herbaceous systems (see, e.g., Belhaj et al., Plant Methods 9: 39 and Harrison et al., Genes & Development 28: 1859-1872). In a particularly advantageous embodiment, the system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a system in the woody perennial *Populus* using the 4-coumarate:CoA ligase (4CL) gene family as a case study and achieved 100% mutational efficiency for two 4CL genes targeted, with every transformant examined carrying biallelic modifications. In the Zhou et al., study, the CRISPR-Cas9 system was highly sensitive to single nucleotide polymorphisms (SNPs), as cleavage for a third 4CL gene was abolished due to SNPs in the target sequence. These methods may be applied to the Cas effector protein system of the present invention.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR-Cas9 editing. The *Populus tremula* x alba clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformation, the gRNA is expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the Cas effector protein system of the present invention.

In plants, pathogens are often host-specific. For example, *Fusarium oxysporum* f. sp. *lycopersici* causes tomato wilt but attacks only tomato, and *F. oxysporum* f. dianthii *Puccinia graminis* f sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

The following table 4 provides additional references and related fields for which the CRISPR-Cas complexes, modified effector proteins, systems, and methods of optimization may be used to improve bioproduction.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

In one embodiment, the method described in Soyk et al. (Nat Genet. 2017 January; 49(1):162-168), which used CRISPR-Cas9 mediated mutation targeting flowering repressor SP5G in tomatoes to produce early yield tomatoes may be modified for the system as disclosed in this invention. In some embodiments, the CRISPR protein is a C2c5.

It is also encompassed herein to provide plant cells and plants generated according to the methods of the invention. Gametes, seeds, germplasm, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target

TABLE 5

| | | |
|---|---|---|
| Feb. 17, 2014 | PCT/US15/63434 (WO2016/099887) | Compositions and methods for efficient gene editing in E. coli using guide RNA/Cas endonuclease systems in combination with circular polynucleotide modification templates. |
| Aug. 13, 2014 | PCT/US15/41256 (WO2016/025131) | Genetic targeting in non-conventional yeast using an RNA-guided endonuclease. |
| Nov. 6, 2014 | PCT/US15/58760 WO2016/073433) | Peptide-mediated delivery of RNA-guided endonuclease into cells. |
| Oct. 12, 2015 | PCT/US16/56404 (WO2017/066175) | Protected DNA templates for gene modification and increased homologous recombination in cells and methods of use. |
| Dec. 11, 2015 | PCT/US16/65070 (WO2017/100158) | Methods and compositions for enhanced nuclease-mediated genome modification and reduced off-target site effects. |
| Dec. 18, 2015 | PCT/US16/65537 (WO2017/105991) | Methods and compositions for T-RNA based guide RNA expression. |
| Dec. 18, 2015 | PCT/US16/66772 (WO2017/106414) | Methods and compositions for polymerase II (Pol-II) based guide RNA expression. |
| Dec. 16, 2014 | PCT/US15/65693 (WO2016/100272) | Fungal genome modification systems and methods of use. |
| Dec. 16, 2014 | PCT/US15/66195 (WO2016/100571) | Fungal genome modification systems and methods of use |
| Dec. 16, 2014 | PCT/US15/66192 WO 2016/100568) | Fungal genome modification systems and methods of use. |
| Dec. 16, 2014 | PCT/US15/66178 (WO 2016/100562) | Use of a helper strain with silenced NHEJ to improve homologous integration of targeted DNA cassettes in Trichoderma reesei. |
| Jul. 28, 2015 | PCT/US16/44489 (WO 2017/019867) | Genome editing systems and methods of use. |

Improved Plants and Yeast Cells

The present invention also provides plants and yeast cells obtainable and obtained by the methods provided herein. The improved plants obtained by the methods described herein may be useful in food or feed production through expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or over-express high levels of oil or alcohols for use in the oil or biofuel industries.

sequence. Alternatively, such plants may contain only an alteration (mutation, deletion, insertion, substitution) in one or more nucleotides. As such, such plants will only be different from their progenitor plants by the presence of the particular modification.

Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants.

The methods for genome editing using the system as described herein can be used to confer desired traits on essentially any plant, algae, fungus, yeast, etc. A wide variety of plants, algae, fungus, yeast, etc. and plant algae, fungus, yeast cell or tissue systems may be engineered for the desired physiological and agronomic characteristics described herein using the nucleic acid constructs of the present disclosure and the various transformation methods mentioned above.

In particular embodiments, the methods described herein are used to modify endogenous genes or to modify their expression without the permanent introduction into the genome of the plant, algae, fungus, yeast, etc. of any foreign gene, including those encoding CRISPR components, so as to avoid the presence of foreign DNA in the genome of the plant. This can be of interest as the regulatory requirements for non-transgenic plants are less rigorous.

The systems provided herein can be used to introduce targeted double-strand or single-strand breaks and/or to introduce gene activator and or repressor systems and without being limitative, can be used for gene targeting, gene replacement, targeted mutagenesis, targeted deletions or insertions, targeted inversions and/or targeted translocations. By co-expression of multiple targeting RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

The methods described herein generally result in the generation of "improved plants, algae, fungi, yeast, etc." in that they have one or more desirable traits compared to the wildtype plant. In particular embodiments, the plants, algae, fungi, yeast, etc., cells or parts obtained are transgenic plants, comprising an exogenous DNA sequence incorporated into the genome of all or part of the cells. In particular embodiments, non-transgenic genetically modified plants, algae, fungi, yeast, etc., parts or cells are obtained, in that no exogenous DNA sequence is incorporated into the genome of any of the cells of the plant. In such embodiments, the improved plants, algae, fungi, yeast, etc. are non-transgenic. Where only the modification of an endogenous gene is ensured and no foreign genes are introduced or maintained in the plant, algae, fungi, yeast, etc. genome, the resulting genetically modified crops contain no foreign genes and can thus basically be considered non-transgenic. The different applications of the system for plant, algae, fungi, yeast, etc. genome editing include, but are not limited to: introduction of one or more foreign genes to confer an agricultural trait of interest; editing of endogenous genes to confer an agricultural trait of interest; modulating of endogenous genes by the system to confer an agricultural trait of interest. Exemplary genes conferring agronomic traits include, but are not limited to genes that confer resistance to pests or diseases; genes involved in plant diseases, such as those listed in WO 2013046247; genes that confer resistance to herbicides, fungicides, or the like; genes involved in (abiotic) stress tolerance. Other aspects of the use of the system include, but are not limited to: create (male) sterile plants; increasing the fertility stage in plants/algae etc.; generate genetic variation in a crop of interest; affect fruit-ripening; increasing storage life of plants/algae etc.; reducing allergen in plants/algae etc.; ensure a value added trait (e.g. nutritional improvement); Screening methods for endogenous genes of interest; biofuel, fatty acid, organic acid, etc. production.

Generation of Micro-Organisms Capable of Fatty Acid Production

In particular embodiments, the methods of the invention are used for the generation of genetically engineered micro-organisms capable of the production of fatty esters, such as fatty acid methyl esters ("FAME") and fatty acid ethyl esters ("FAEE"), Typically, host cells can be engineered to produce fatty esters from a carbon source, such as an alcohol, present in the medium, by expression or overexpression of a gene encoding a thioesterase, a gene encoding an acyl-CoA synthase, and a gene encoding an ester synthase. Accordingly, the methods provided herein are used to modify a micro-organisms so as to overexpress or introduce a thioesterase gene, a gene encoding an acyl-CoA synthase, and a gene encoding an ester synthase. In particular embodiments, the thioesterase gene is selected from tesA, 'tesA, tesB, fatB, fatB2, fatB3, fatAl, or fatA. In particular embodiments, the gene encoding an acyl-CoA synthase is selected from fadDJadK, BH3103, pfl-4354, EAV15023, fadD1, fadD2, RPC_4074, fadDD35, fadDD22, faa39, or an identified gene encoding an enzyme having the same properties. In particular embodiments, the gene encoding an ester synthase is a gene encoding a synthase/acyl-CoA:diacylglycerl acyltransferase from *Simmondsia chinensis, Acinetobacter* sp. ADP, *Alcanivorax borkumensis, Pseudomonas aeruginosa, Fundibacter jadensis, Arabidopsis thaliana*, or *Alkaligenes eutrophus*, or a variant thereof. Additionally or alternatively, the methods provided herein are used to decrease expression in said micro-organism of at least one of a gene encoding an acyl-CoA dehydrogenase, a gene encoding an outer membrane protein receptor, and a gene encoding a transcriptional regulator of fatty acid biosynthesis. In particular embodiments one or more of these genes is inactivated, such as by introduction of a mutation. In particular embodiments, the gene encoding an acyl-CoA dehydrogenase is fadE. In particular embodiments, the gene encoding a transcriptional regulator of fatty acid biosynthesis encodes a DNA transcription repressor, for example, fabR.

Additionally or alternatively, said micro-organism is modified to reduce expression of at least one of a gene encoding a pyruvate formate lyase, a gene encoding a lactate dehydrogenase, or both. In particular embodiments, the gene encoding a pyruvate formate lyase is pflB. In particular embodiments, the gene encoding a lactate dehydrogenase is IdhA. In particular embodiments one or more of these genes is inactivated, such as by introduction of a mutation therein.

In particular embodiments, the micro-organism is selected from the genus *Escherichia, Bacillus, Lactobacillus, Rhodococcus*, Synechococcus, Synechoystis, *Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia*, or *Streptomyces*.

Generation of Micro-Organisms Capable of Organic Acid Production

The methods provided herein are further used to engineer micro-organisms capable of organic acid production, more particularly from pentose or hexose sugars. In particular embodiments, the methods comprise introducing into a micro-organism an exogenous LDH gene. In particular embodiments, the organic acid production in said micro-organisms is additionally or alternatively increased by inactivating endogenous genes encoding proteins involved in an endogenous metabolic pathway which produces a metabolite other than the organic acid of interest and/or wherein the endogenous metabolic pathway consumes the organic acid. In particular embodiments, the modification ensures that the production of the metabolite other than the organic acid of interest is reduced. According to particular embodiments, the methods are used to introduce at least one engineered gene deletion and/or inactivation of an endogenous pathway in which the organic acid is consumed or a gene encoding a product involved in an endogenous pathway which produces a metabolite other than the organic acid of interest. In particular embodiments, the at least one engineered gene deletion or inactivation is in one or more gene encoding an enzyme selected from the group consisting of pyruvate decarboxylase (pdc), fumarate reductase, alcohol dehydrogenase (adh), acetaldehyde dehydrogenase, phosphoenolpyruvate carboxylase (ppc), D-lactate dehydrogenase (d-ldh), L-lactate dehydrogenase (l-ldh), lactate 2-monooxygenase. In further embodiments the at least one engineered gene deletion and/or inactivation is in an endogenous gene encoding pyruvate decarboxylase (pdc).

In further embodiments, the micro-organism is engineered to produce lactic acid and the at least one engineered gene deletion and/or inactivation is in an endogenous gene encoding lactate dehydrogenase. Additionally or alternatively, the micro-organism comprises at least one engineered gene deletion or inactivation of an endogenous gene encoding a cytochrome-dependent lactate dehydrogenase, such as a cytochrome B2-dependent L-lactate dehydrogenase.

Applications in Animals and Human

The systems and methods may be used in non-human animals. In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal; for example a mammal. Also, the organism may be an arthropod such as an insect. The present invention may also be extended to other agricultural applications such as, for example, farm and production animals. For example, pigs have many features that make them attractive as biomedical models, especially in regenerative medicine. In particular, pigs with severe combined immunodeficiency (SCID) may provide useful models for regenerative medicine, xenotransplantation (discussed also elsewhere herein), and tumor development and will aid in developing therapies for human SCID patients. Lee et al., (Proc Natl Acad Sci USA. 2014 May 20; 111(20):7260-5) utilized a reporter-guided transcription activator-like effector nuclease (TALEN) system to generated targeted modifications of recombination activating gene (RAG) 2 in somatic cells at high efficiency, including some that affected both alleles. The Type V effector protein may be applied to a similar system.

The methods of Lee et al., (Proc Natl Acad Sci USA. 2014 May 20; 111(20):7260-5) may be applied to the present invention analogously as follows. Mutated pigs are produced by targeted insertion for example in RAG2 in fetal fibroblast cells followed by SCNT and embryo transfer. Constructs coding for CRISPR Cas and a reporter are electroporated into fetal-derived fibroblast cells. After 48 h, transfected cells expressing the green fluorescent protein are sorted into individual wells of a 96-well plate at an estimated dilution of a single cell per well. Targeted modification of RAG2 are screened by amplifying a genomic DNA fragment flanking any CRISPR Cas cutting sites followed by sequencing the PCR products. After screening and ensuring lack of off-site mutations, cells carrying targeted modification of RAG2 are used for SCNT. The polar body, along with a portion of the adjacent cytoplasm of oocyte, presumably containing the metaphase II plate, are removed, and a donor cell are placed in the perivitelline. The reconstructed embryos are then electrically porated to fuse the donor cell with the oocyte and then chemically activated. The activated embryos are incubated in Porcine Zygote Medium 3 (PZM3) with 0.5 µM Scriptaid (S7817; Sigma-Aldrich) for 14-16 h. Embryos are then washed to remove the Scriptaid and cultured in PZM3 until they were transferred into the oviducts of surrogate pigs.

The present invention is used to create a platform to model a disease or disorder of an animal, in some embodiments a mammal, in some embodiments a human. In certain embodiments, such models and platforms are rodent based, in non-limiting examples rat or mouse. Such models and platforms can take advantage of distinctions among and comparisons between inbred rodent strains. In certain embodiments, such models and platforms primate, horse, cattle, sheep, goat, swine, dog, cat or bird-based, for example to directly model diseases and disorders of such animals or to create modified and/or improved lines of such animals. Advantageously, in certain embodiments, an animal based platform or model is created to mimic a human disease or disorder. For example, the similarities of swine to humans make swine an ideal platform for modeling human diseases. Compared to rodent models, development of swine models has been costly and time intensive. On the other hand, swine and other animals are much more similar to humans genetically, anatomically, physiologically and pathophysiologically. The present invention provides a high efficiency platform for targeted gene and genome editing, gene and genome modification and gene and genome regulation to be used in such animal platforms and models. Though ethical standards block development of human models and in many cases models based on non-human primates, the present invention is used with in vitro systems, including but not limited to cell culture systems, three dimensional models and systems, and organoids to mimic, model, and investigate genetics, anatomy, physiology and pathophysiology of structures, organs, and systems of humans. The platforms and models provide manipulation of single or multiple targets.

In certain embodiments, the present invention is applicable to disease models like that of Schomberg et al. (FASEB Journal, April 2016; 30(1):Suppl 571.1). To model the inherited disease neurofibromatosis type 1 (NF-1) Schomberg used CRISPR-Cas9 to introduce mutations in the swine neurofibromin 1 gene by cytosolic microinjection of CRISPR/Cas9 components into swine embryos. CRISPR guide RNAs (gRNA) were created for regions targeting sites both upstream and downstream of an exon within the gene for targeted cleavage by Cas9 and repair was mediated by a specific single-stranded oligodeoxynucleotide (ssODN) template to introduce a 2500 bp deletion. The system was also used to engineer swine with specific NF-1 mutations or clusters of mutations, and further can be used to engineer mutations that are specific to or representative of a given human individual. The invention is similarly used to develop animal models, including but not limited to swine models, of human multigenic diseases. According to the invention, multiple genetic loci in one gene or in multiple genes are simultaneously targeted using multiplexed guides and optionally one or multiple templates.

The present invention is also applicable to modifying SNPs of other animals, such as cows. Tan et al. (Proc Natl Acad Sci USA. 2013 Oct. 8; 110(41): 16526-16531) expanded the livestock gene editing toolbox to include transcription activator-like (TAL) effector nuclease (TALEN)- and clustered regularly interspaced short palindromic repeats (CRISPR)/Cas9-stimulated homology-directed repair (HDR) using plasmid, rAAV, and oligonucleotide templates. Gene specific gRNA sequences were cloned into the Church lab gRNA vector (Addgene ID: 41824) according to their methods (Mali P, et al. (2013) RNA-Guided Human Genome Engineering via Cas9. Science 339(6121):823-826). The Cas9 nuclease was provided either by co-transfection of the hCas9 plasmid (Addgene ID: 41815) or mRNA synthesized from RCIScript-hCas9. This RCIScript-hCas9 was constructed by sub-cloning the XbaI-AgeI fragment from the hCas9 plasmid (encompassing the hCas9 cDNA) into the RCIScript plasmid.

Heo et al. (Stem Cells Dev. 2015 Feb. 1; 24(3):393-402. doi: 10.1089/scd.2014.0278. Epub 2014 Nov. 3) reported highly efficient gene targeting in the bovine genome using bovine pluripotent cells and clustered regularly interspaced short palindromic repeat (CRISPR)/Cas9 nuclease. First, Heo et al. generate induced pluripotent stem cells (iPSCs) from bovine somatic fibroblasts by the ectopic expression of yamanaka factors and GSK3f3 and MEK inhibitor (2i) treatment. Heo et al. observed that these bovine iPSCs are highly similar to naive pluripotent stem cells with regard to gene expression and developmental potential in teratomas. Moreover, CRISPR-Cas9 nuclease, which was specific for the bovine NANOG locus, showed highly efficient editing of the bovine genome in bovine iPSCs and embryos.

Igenity® provides a profile analysis of animals, such as cows, to perform and transmit traits of economic traits of economic importance, such as carcass composition, carcass quality, maternal and reproductive traits and average daily gain. The analysis of a comprehensive Igenity® profile begins with the discovery of DNA markers (most often single nucleotide polymorphisms or SNPs). All the markers behind the Igenity® profile were discovered by independent scientists at research institutions, including universities, research organizations, and government entities such as USDA. Markers are then analyzed at Igenity® in validation populations. Igenity® uses multiple resource populations that represent various production environments and biological types, often working with industry partners from the seedstock, cow-calf, feedlot and/or packing segments of the beef industry to collect phenotypes that are not commonly available. Cattle genome databases are widely available, see, e.g., the NAGRP Cattle Genome Coordination Program (www.animalgenome.org/cattle/maps/db.html). Thus, the present invention maybe applied to target bovine SNPs. One of skill in the art may utilize the above protocols for targeting SNPs and apply them to bovine SNPs as described, for example, by Tan et al. or Heo et al.

Qingjian Zou et al. (Journal of Molecular Cell Biology Advance Access published Oct. 12, 2015) demonstrated increased muscle mass in dogs by targeting the first exon of the dog Myostatin (MSTN) gene (a negative regulator of skeletal muscle mass). First, the efficiency of the sgRNA was validated, using cotransfection of the sgRNA targeting MSTN with a Cas9 vector into canine embryonic fibroblasts (CEFs). Thereafter, MSTN KO dogs were generated by micro-injecting embryos with normal morphology with a mixture of Cas9 mRNA and MSTN sgRNA and auto-transplantation of the zygotes into the oviduct of the same female dog. The knock-out puppies displayed an obvious muscular phenotype on thighs compared with its wild-type littermate sister. This can also be performed using the Type V CRISPR systems provided herein.

Livestock—Pigs

Viral targets in livestock may include, in some embodiments, porcine CD163, for example on porcine macrophages. CD163 is associated with infection (thought to be through viral cell entry) by PRRSv (Porcine Reproductive and Respiratory Syndrome virus, an arterivirus). Infection by PRRSv, especially of porcine alveolar macrophages (found in the lung), results in a previously incurable porcine syndrome ("Mystery swine disease" or "blue ear disease") that causes suffering, including reproductive failure, weight loss and high mortality rates in domestic pigs. Opportunistic infections, such as enzootic pneumonia, meningitis and ear oedema, are often seen due to immune deficiency through loss of macrophage activity. It also has significant economic and environmental repercussions due to increased antibiotic use and financial loss (an estimated $660m per year).

As reported by Kristin M Whitworth and Dr Randall Prather et al. (Nature Biotech 3434 published online 7 Dec. 2015) at the University of Missouri and in collaboration with Genus Plc, CD163 was targeted using CRISPR-Cas9 and the offspring of edited pigs were resistant when exposed to PRRSv. One founder male and one founder female, both of whom had mutations in exon 7 of CD163, were bred to produce offspring. The founder male possessed an 11-bp deletion in exon 7 on one allele, which results in a frameshift mutation and missense translation at amino acid 45 in domain 5 and a subsequent premature stop codon at amino acid 64. The other allele had a 2-bp addition in exon 7 and a 377-bp deletion in the preceding intron, which were predicted to result in the expression of the first 49 amino acids of domain 5, followed by a premature stop code at amino acid 85. The sow had a 7 bp addition in one allele that when translated was predicted to express the first 48 amino acids of domain 5, followed by a premature stop codon at amino acid 70. The sow's other allele was unamplifiable. Selected offspring were predicted to be a null animal (CD163−/−), i.e. a CD163 knock out.

Accordingly, in some embodiments, porcine alveolar macrophages may be targeted by the CRISPR protein. In some embodiments, porcine CD163 may be targeted by the system. In some embodiments, porcine CD163 may be knocked out through induction of a DSB or through insertions or deletions, for example targeting deletion or modification of exon 7, including one or more of those described above, or in other regions of the gene, for example deletion or modification of exon 5.

An edited pig and its progeny are also envisaged, for example a CD163 knock out pig. This may be for livestock, breeding or modelling purposes (i.e. a porcine model). Semen comprising the gene knock out is also provided.

CD163 is a member of the scavenger receptor cysteine-rich (SRCR) superfamily. Based on in vitro studies SRCR domain 5 of the protein is the domain responsible for unpackaging and release of the viral genome. As such, other members of the SRCR superfamily may also be targeted in order to assess resistance to other viruses. PRRSV is also a member of the mammalian arterivirus group, which also includes murine lactate dehydrogenase-elevating virus, simian hemorrhagic fever virus and equine arteritis virus. The arteriviruses share important pathogenesis properties, including macrophage tropism and the capacity to cause both severe disease and persistent infection. Accordingly, arteriviruses, and in particular murine lactate dehydrogenase-elevating virus, simian hemorrhagic fever virus and equine arteritis virus, may be targeted, for example through porcine CD163 or homologues thereof in other species, and murine, simian and equine models and knockout also provided.

Indeed, this approach may be extended to viruses or bacteria that cause other livestock diseases that may be transmitted to humans, such as Swine Influenza Virus (SIV) strains which include influenza C and the subtypes of influenza A known as H1N1, H1N2, H2N1, H3N1, H3N2, and H2N3, as well as pneumonia, meningitis and oedema mentioned above.

Models of Genetic and Epigenetic Conditions

The systems and methods herein may be used to create a plant, an animal or cell that may be used to model and/or study genetic or epigenetic conditions of interest, such as a through a model of mutations of interest or a disease model. As used herein, "disease" refers to a disease, disorder, or indication in a subject. For example, a method of the invention may be used to create an animal or cell that comprises a modification in one or more nucleic acid sequences associated with a disease, or a plant, animal or cell in which the expression of one or more nucleic acid sequences associated with a disease are altered. Such a nucleic acid sequence may encode a disease associated protein sequence or may be a disease associated control sequence. Accordingly, it is understood that in embodiments of the invention, a plant, subject, patient, organism or cell can be a non-human subject, patient, organism or cell. Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged.

In some methods, the disease model can be used to study the effects of mutations on the animal or cell and development and/or progression of the disease using measures commonly used in the study of the disease. Alternatively, such a disease model is useful for studying the effect of a pharmaceutically active compound on the disease.

In some methods, the disease model can be used to assess the efficacy of a potential gene therapy strategy. That is, a disease-associated gene or polynucleotide can be modified such that the disease development and/or progression is inhibited or reduced. In particular, the method comprises modifying a disease-associated gene or polynucleotide such that an altered protein is produced and, as a result, the animal or cell has an altered response. Accordingly, in some methods, a genetically modified animal may be compared with an animal predisposed to development of the disease such that the effect of the gene therapy event may be assessed.

In another embodiment, this invention provides a method of developing a biologically active agent that modulates a cell signaling event associated with a disease gene. The method comprises contacting a test compound with a cell comprising one or more vectors that drive expression of one or more of components of the system; and detecting a change in a readout that is indicative of a reduction or an augmentation of a cell signaling event associated with, e.g., a mutation in a disease gene contained in the cell.

A cell model or animal model can be constructed in combination with the method of the invention for screening a cellular function change. Such a model may be used to study the effects of a genome sequence modified by the systems and methods herein on a cellular function of interest. For example, a cellular function model may be used to study the effect of a modified genome sequence on intracellular signaling or extracellular signaling. Alternatively, a cellular function model may be used to study the effects of a modified genome sequence on sensory perception. In some such models, one or more genome sequences associated with a signaling biochemical pathway in the model are modified.

Several disease models have been specifically investigated. These include de novo autism risk genes CHD8, KATNAL2, and SCN2A; and the syndromic autism (Angelman Syndrome) gene UBE3A. These genes and resulting autism models are of course preferred, but serve to show the broad applicability of the invention across genes and corresponding models. An altered expression of one or more genome sequences associated with a signaling biochemical pathway can be determined by assaying for a difference in the mRNA levels of the corresponding genes between the test model cell and a control cell, when they are contacted with a candidate agent. Alternatively, the differential expression of the sequences associated with a signaling biochemical pathway is determined by detecting a difference in the level of the encoded polypeptide or gene product.

To assay for an agent-induced alteration in the level of mRNA transcripts or corresponding polynucleotides, nucleic acid contained in a sample is first extracted according to standard methods in the art. For instance, mRNA can be isolated using various lytic enzymes or chemical solutions according to the procedures set forth in Sambrook et al. (1989), or extracted by nucleic-acid-binding resins following the accompanying instructions provided by the manufacturers. The mRNA contained in the extracted nucleic acid sample is then detected by amplification procedures or conventional hybridization assays (e.g. Northern blot analysis) according to methods widely known in the art or based on the methods exemplified herein.

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of *E. coli* DNA polymerase, and reverse transcriptase. A preferred amplification method is PCR. In particular, the isolated RNA can be subjected to a reverse transcription assay that is coupled with a quantitative polymerase chain reaction (RT-PCR) in order to quantify the expression level of a sequence associated with a signaling biochemical pathway.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules is typically proportional to the amount of the amplified DNA products, one can conveniently determine the amount of the amplified products by quantifying the fluorescence of the intercalated dye using conventional optical systems in the art. DNA-binding dye suitable for this application include SYBR green, SYBR blue, DAPI, propidium iodine, Hoeste, SYBR gold, ethidium bromide, acridines, proflavine, acridine orange, acriflavine, fluorcoumanin, ellipticine, daunomycin, chloroquine, distamycin D, chromomycin, homidium, mithramycin, ruthenium polypyridyls, anthramycin, and the like.

In another aspect, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan® probes) resulting in increased specificity and sensitivity. Methods for performing probe-based quantitative amplification are well established in the art and are taught in U.S. Pat. No. 5,210,015.

In yet another aspect, conventional hybridization assays using hybridization probes that share sequence homology with sequences associated with a signaling biochemical pathway can be performed. Typically, probes are allowed to form stable complexes with the sequences associated with a signaling biochemical pathway contained within the biological sample derived from the test subject in a hybridization reaction. It will be appreciated by one of skill in the art that where antisense is used as the probe nucleic acid, the target polynucleotides provided in the sample are chosen to be complementary to sequences of the antisense nucleic acids. Conversely, where the nucleotide probe is a sense nucleic acid, the target polynucleotide is selected to be complementary to sequences of the sense nucleic acid.

Hybridization can be performed under conditions of various stringency. Suitable hybridization conditions for the practice of the present invention are such that the recognition interaction between the probe and sequences associated with a signaling biochemical pathway is both sufficiently specific and sufficiently stable. Conditions that increase the stringency of a hybridization reaction are widely known and published in the art. See, for example, (Sambrook, et al., (1989); Nonradioactive In Situ Hybridization Application Manual, Boehringer Mannheim, second edition). The hybridization assay can be formed using probes immobilized on any solid support, including but are not limited to nitrocellulose, glass, silicon, and a variety of gene arrays. A preferred hybridization assay is conducted on high-density gene chips as described in U.S. Pat. No. 5,445,934.

For a convenient detection of the probe-target complexes formed during the hybridization assay, the nucleotide probes are conjugated to a detectable label. Detectable labels suitable for use in the present invention include any composition detectable by photochemical, biochemical, spectroscopic, immunochemical, electrical, optical or chemical means. A wide variety of appropriate detectable labels are known in the art, which include fluorescent or chemiluminescent labels, radioactive isotope labels, enzymatic or other ligands. In preferred embodiments, one will likely desire to employ a fluorescent label or an enzyme tag, such as digoxigenin, ß-galactosidase, urease, alkaline phosphatase or peroxidase, avidin/biotin complex.

The detection methods used to detect or quantify the hybridization intensity will typically depend upon the label selected above. For example, radiolabels may be detected using photographic film or a phosphoimager. Fluorescent markers may be detected and quantified using a photodetector to detect emitted light. Enzymatic labels are typically detected by providing the enzyme with a substrate and measuring the reaction product produced by the action of the enzyme on the substrate; and finally colorimetric labels are detected by simply visualizing the colored label.

An agent-induced change in expression of sequences associated with a signaling biochemical pathway can also be determined by examining the corresponding gene products. Determining the protein level typically involves a) contacting the protein contained in a biological sample with an agent that specifically bind to a protein associated with a signaling biochemical pathway; and (b) identifying any agent:protein complex so formed. In one aspect of this embodiment, the agent that specifically binds a protein associated with a signaling biochemical pathway is an antibody, preferably a monoclonal antibody.

The reaction is performed by contacting the agent with a sample of the proteins associated with a signaling biochemical pathway derived from the test samples under conditions that will allow a complex to form between the agent and the proteins associated with a signaling biochemical pathway. The formation of the complex can be detected directly or indirectly according to standard procedures in the art. In the direct detection method, the agents are supplied with a detectable label and unreacted agents may be removed from the complex; the amount of remaining label thereby indicating the amount of complex formed. For such method, it is preferable to select labels that remain attached to the agents even during stringent washing conditions. It is preferable that the label does not interfere with the binding reaction. In the alternative, an indirect detection procedure may use an agent that contains a label introduced either chemically or enzymatically. A desirable label generally does not interfere with binding or the stability of the resulting agent:polypeptide complex. However, the label is typically designed to be accessible to an antibody for an effective binding and hence generating a detectable signal.

A wide variety of labels suitable for detecting protein levels are known in the art. Non-limiting examples include radioisotopes, enzymes, colloidal metals, fluorescent compounds, bioluminescent compounds, and chemiluminescent compounds.

The amount of agent:polypeptide complexes formed during the binding reaction can be quantified by standard quantitative assays. As illustrated above, the formation of agent:polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

A number of techniques for protein analysis based on the general principles outlined above are available in the art. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SD S-PAGE.

Antibodies that specifically recognize or bind to proteins associated with a signaling biochemical pathway are preferable for conducting the aforementioned protein analyses. Where desired, antibodies that recognize a specific type of post-translational modifications (e.g., signaling biochemical pathway inducible modifications) can be used. Post-translational modifications include but are not limited to glycosylation, lipidation, acetylation, and phosphorylation. These antibodies may be purchased from commercial vendors. For example, anti-phosphotyrosine antibodies that specifically recognize tyrosine-phosphorylated proteins are available from a number of vendors including Invitrogen and Perkin Elmer. Anti-phosphotyrosine antibodies are particularly useful in detecting proteins that are differentially phosphorylated on their tyrosine residues in response to an ER stress.

Such proteins include but are not limited to eukaryotic translation initiation factor 2 alpha (eIF-2a). Alternatively, these antibodies can be generated using conventional polyclonal or monoclonal antibody technologies by immunizing a host animal or an antibody-producing cell with a target protein that exhibits the desired post-translational modification.

In practicing the subject method, it may be desirable to discern the expression pattern of an protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

An altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays such as AlphaScreen™ (available from Perkin Elmer) and eTag™ assay (Chan-Hui, et al. (2003) Clinical Immunology 111: 162-174).

Where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are particularly suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a millisecond.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA).

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non-disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

The target polynucleotide of the system herein can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Without wishing to be bound by theory, it is believed that the target sequence should be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence). Examples of PAM sequences are given in the examples section below, and the skilled person will be able to identify further PAM sequences for use with a given CRISPR enzyme.

The target polynucleotide of the system may include a number of disease-associated genes and polynucleotides as well as signaling biochemical pathway-associated genes and polynucleotides as listed in U.S. provisional patent applications 61/736,527 and 61/748,427 having Broad reference BI-2011/008/WSGR Docket No. 44063-701.101 and BI-2011/008/WSGR Docket No. 44063-701.102 respectively, both entitled SYSTEMS METHODS AND COMPOSITIONS FOR SEQUENCE MANIPULATION filed on Dec. 12, 2012 and Jan. 2, 2013, respectively, and PCT Application PCT/US2013/074667, entitled DELIVERY, ENGINEERING AND OPTIMIZATION OF SYSTEMS, METHODS AND COMPOSITIONS FOR SEQUENCE MANIPULATION AND THERAPEUTIC APPLICATIONS, filed Dec. 12, 2013, the contents of all of which are herein incorporated by reference in their entirety.

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non-disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

Therapeutic Applications

The present invention also contemplates use of the systems described herein, for treatment in a variety of diseases and disorders. In embodiments, the invention described herein relates to a method for therapy in which cells are edited ex vivo by the system to modulate at least one gene, with subsequent administration of the edited cells to a patient in need thereof. In some embodiments, the editing involves knocking in, knocking out or knocking down expression of at least one target gene in a cell. In particular embodiments, the system inserts an exogenous, gene, minigene or sequence, which may comprise one or more exons and introns or natural or synthetic introns into the locus of a target gene, a hot-spot locus, a safe harbor locus of the gene genomic locations where new genes or genetic elements can be introduced without disrupting the expression or regulation of adjacent genes, or correction by insertions or deletions one or more mutations in DNA sequences that encode regulatory elements of a target gene.

In some embodiments, the treatment is for disease/disorder of an organ, including liver disease, eye disease, muscle disease, heart disease, blood disease, brain disease, kidney disease, or may comprise treatment for an autoimmune disease, central nervous system disease, cancer and other proliferative diseases, neurodegenerative disorders, inflammatory disease, metabolic disorder, musculoskeletal disorder and the like.

Particular diseases/disorders include chondroplasia, achromatopsia, acid maltase deficiency, adrenoleukodystrophy, aicardi syndrome, alpha-1 antitrypsin deficiency, alpha-thalassemia, androgen insensitivity syndrome, apert syndrome, arrhythmogenic right ventricular, dysplasia, ataxia telangictasia, barth syndrome, beta-thalassemia, blue rubber bleb nevus syndrome, canavan disease, chronic granulomatous diseases (CGD), cri du chat syndrome, cystic fibrosis, dercum's disease, ectodermal dysplasia, fanconi anemia, fibrodysplasia ossificans progressive, fragile X syndrome, galactosemis, Gaucher's disease, generalized gangliosidoses (e.g., GM1), hemochromatosis, the hemoglobin C mutation in the 6th codon of beta-globin (HbC), hemophilia, Huntington's disease, Hurler Syndrome, hypophosphatasia, Klinefleter syndrome, Krabbes Disease, Langer-Giedion Syndrome, leukodystrophy, long QT syndrome, Marfan syndrome, Moebius syndrome, mucopolysaccharidosis (MPS), nail patella syndrome, nephrogenic diabetes insipdius, neurofibromatosis, Neimann-Pick disease, osteogenesis imperfecta, *porphyria*, Prader-Willi syndrome, progeria, *Proteus* syndrome, retinoblastoma, Rett syndrome, Rubinstein-Taybi syndrome, Sanfilippo syndrome, severe combined immunodeficiency (SCID), Shwachman syndrome, sickle cell disease (sickle cell anemia), Smith-Magenis syndrome, Stickler syndrome, Tay-Sachs disease, Thrombocytopenia Absent Radius (TAR) syndrome, Treacher Collins syndrome, trisomy, tuberous sclerosis, Turner's syndrome, urea cycle disorder, von Hippel-Landau disease, Waardenburg syndrome, Williams syndrome, Wilson's disease, and Wiskott-Aldrich syndrome.

In some embodiments, the disease is associated with expression of a tumor antigen, e.g., a proliferative disease, a precancerous condition, a cancer, or a non-cancer related indication associated with expression of the tumor antigen, which may in some embodiments comprise a target selected from B2M, CD247, CD3D, CD3E, CD3G, TRAC, TRBC1, TRBC2, HLA-A, HLA-B, HLA-C, DCK, CD52, FKBP1A, CIITA, NLRC5, RFXANK, RFX5, RFXAP, or NR3C1, HAVCR2, LAG3, PDCD1, PD-L2, CTLA4, CEACAM (CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MEW class I, MHC class II, GALS, adenosine, and TGF beta, or PTPN11 DCK, CD52, NR3C1, LILRB1, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bDGalp(1-4)bDG1cp(1-1) Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); n kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4)bDG1cp(1-1)Cer); transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2

(LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B 1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAXS); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRLS); and immunoglobulin lambda-like polypeptide 1 (IGLL1), CD19, BCMA, CD70, G6PC, Dystrophin, including modification of exon 51 by deletion or excision, DMPK, CFTR (cystic fibrosis transmembrane conductance regulator). In embodiments, the targets comprise CD70, or a Knock-in of CD33 and Knock-out of B2M. In embodiments, the targets comprise a knockout of TRAC and B2M, or TRAC B2M and PD1, with or without additional target genes. In certain embodiments, the disease is cystic fibrosis with targeting of the SCNN1A gene, e.g., the non-coding or coding regions, e.g., a promoter region, or a transcribed sequence, e.g., intronic or exonic sequence, targeted knock-in at CFTR sequence within intron 2, into which, e.g., can be introduced CFTR sequence that codes for CFTR exons 3-27; and sequence within CFTR intron 10, into which sequence that codes for CFTR exons 11-27 can be introduced.

In some embodiments, the disease is Metachromatic Leukodystrophy, and the target is Arylsulfatase A, the disease is Wiskott-Aldrich Syndrome and the target is Wiskott-Aldrich Syndrome protein, the disease is Adreno leukodystrophy and the target is ATP-binding cassette DI, the disease is Human Immunodeficiency Virus and the target is receptor type 5-C-C chemokine or CXCR4 gene, the disease is Beta-thalassemia and the target is Hemoglobin beta subunit, the disease is X-linked Severe Combined ID receptor subunit gamma and the target is interelukin-2 receptor subunit gamma, the disease is Multisystemic Lysosomal Storage Disorder cystinosis and the target is cystinosin, the disease is Diamon-Blackfan anemia and the target is Ribosomal protein S19, the disease is Fanconi Anemia and the target is Fanconi anemia complementation groups (e.g. FNACA, FNACB, FANCC, FANCD1, FANCD2, FANCE, FANCF, RAD51C), the disease is Shwachman-Bodian-Diamond Bodian-Diamond syndrome and the target is Shwachman syndrome gene, the disease is Gaucher's disease and the target is Glucocerebrosidase, the disease is Hemophilia A and the target is Anti-hemophiliac factor OR Factor VIII, Christmas factor, Serine protease, Factor Hemophilia B IX, the disease is Adenosine deaminase deficiency (ADA-SCID) and the target is Adenosine deaminase, the disease is GM1 gangliosidoses and the target is beta-galactosidase, the disease is Glycogen storage disease type II, Pompe disease, the disease is acid maltase deficiency acid and the target is alpha-glucosidase, the disease is Niemann-Pick disease, SMPD1-associated (Types Sphingomyelin phosphodiesterase 1 OR A and B) acid and the target is sphingomyelinase, the disease is Krabbe disease, globoid cell leukodystrophy and the target is Galactosylceramidase or galactosylceramide lipidosis and the target is galactercerebrosidease, Human leukocyte antigens DR-15, DQ-6, the disease is Multiple Sclerosis (MS) DRB1, the disease is Herpes Simplex Virus 1 or 2 and the target is knocking down of one, two or three of RS1, RL2 and/or LAT genes. In embodiments, the disease is an HPV associated cancer with treatment including edited cells comprising binding molecules, such as TCRs or antigen binding fragments thereof and antibodies and antigen-binding fragments thereof, such as those that recognize or bind human papilloma virus. The disease can be Hepatitis B with a target of one or more of PreC, C, X, PreS1, PreS2, S, P and/or SP gene(s).

In some embodiments, the immune disease is severe combined immunodeficiency (SCID), Omenn syndrome, and in one aspect the target is Recombination Activating Gene 1 (RAG1) or an interleukin-7 receptor (IL7R). In particular embodiments, the disease is Transthyretin Amyloidosis (ATTR), Familial amyloid cardiomyopathy, and in one aspect, the target is the TTR gene, including one or more mutations in the TTR gene. In embodiments, the disease is Alpha-1 Antitrypsin Deficiency (AATD) or another disease in which Alpha-1 Antitrypsin is implicated, for example GvHD, Organ transplant rejection, diabetes, liver disease, COPD, Emphysema and Cystic Fibrosis, in particular embodiments, the target is SERPINA 1.

In some embodiments, the disease is primary hyperoxaluria, which, in certain embodiments, the target comprises one or more of Lactate dehydrogenase A (LDHA) and hydroxy Acid Oxidase 1 (HAO 1). In embodiments, the disease is primary hyperoxaluria type 1 (phl) and other alanine-glyoxylate aminotransferase (agxt) gene related conditions or disorders, such as Adenocarcinoma, Chronic Alcoholic Intoxication, Alzheimer's Disease, Cooley's anemia, Aneurysm, Anxiety Disorders, Asthma, Malignant neoplasm of breast, Malignant neoplasm of skin, Renal Cell Carcinoma, Cardiovascular Diseases, Malignant tumor of cervix, Coronary Arteriosclerosis, Coronary heart disease, Diabetes, Diabetes Mellitus, Diabetes Mellitus Non-Insulin-Dependent, Diabetic Nephropathy, Eclampsia, Eczema, Subacute Bacterial Endocarditis, Glioblastoma, Glycogen storage disease type II, Sensorineural Hearing Loss (disorder), Hepatitis, Hepatitis A, Hepatitis B, Homocystinuria, Hereditary Sensory Autonomic Neuropathy Type 1, Hyperaldosteronism, Hypercholesterolemia, Hyperoxaluria, Primary Hyperoxaluria, Hypertensive disease, Inflammatory Bowel Diseases, Kidney Calculi, Kidney Diseases, Chronic Kidney Failure, leiomyosarcoma, Metabolic Diseases, Inborn Errors of Metabolism, Mitral Valve Prolapse Syndrome, Myocardial Infarction, Neoplasm Metastasis, Nephrotic Syndrome, Obesity, Ovarian Diseases, Periodontitis, Polycystic Ovary Syndrome, Kidney Failure, Adult Respiratory Distress Syndrome, Retinal Diseases, Cerebrovascular accident, Turner Syndrome, Viral hepatitis, Tooth Loss, Premature Ovarian Failure, Essential Hypertension, Left Ventricular Hypertrophy, Migraine Disorders, Cutaneous Melanoma, Hypertensive heart disease, Chronic glomerulonephritis, Migraine with Aura, Secondary hypertension, Acute myocardial infarction, Atherosclerosis of aorta, Allergic asthma, pineoblastoma, Malignant neoplasm of lung, Primary hyperoxaluria type I, Primary hyperoxaluria type 2, Inflammatory Breast Carcinoma, Cervix carcinoma, Restenosis, Bleeding ulcer, Generalized glycogen storage disease of infants, Nephrolithiasis, Chronic rejection of renal transplant, Urolithiasis, pricking of skin, Metabolic Syndrome X, Maternal hypertension, Carotid Atherosclerosis, Carcinogenesis, Breast Carcinoma, Carcinoma of lung, Nephronophthisis, Microalbuminuria, Familial Retinoblastoma, Systolic Heart Failure Ischemic stroke, Left ventricular systolic dysfunction, Cauda Equina Paraganglioma, Hepatocarcinogenesis, Chronic Kidney Diseases, Glioblastoma Multiforme, Non-Neoplastic Disorder, Calcium Oxalate Nephrolithiasis, Ablepharon-Macrostomia Syndrome, Coronary Artery Disease, Liver carcinoma, Chronic kidney disease stage 5, Allergic rhinitis (disorder), Crigler Najjar syndrome type 2, and Ischemic Cerebrovascular Accident. In certain embodiments, treatment is targeted to the liver. In embodiments, the gene is AGXT, with a cytogenetic location of 2q37.3 and the genomic coordinate are on Chromosome 2 on the forward strand at position 240,868,479-240,880,502.

Treatment can also target collagen type vii alpha 1 chain (col7a1) gene related conditions or disorders, such as Malignant neoplasm of skin, Squamous cell carcinoma, Colorectal Neoplasms, Crohn Disease, Epidermolysis Bullosa, Indirect Inguinal Hernia, Pruritus, Schizophrenia, Dermatologic disorders, Genetic Skin Diseases, Teratoma, Cockayne-Touraine Disease, Epidermolysis Bullosa Acquisita, Epidermolysis Bullosa Dystrophica, Junctional Epidermolysis Bullosa, Hallopeau-Siemens Disease, Bullous Skin Diseases, Agenesis of corpus callosum, Dystrophia unguium, Vesicular Stomatitis, Epidermolysis Bullosa With Congenital Localized Absence Of Skin And Deformity Of Nails, Juvenile Myoclonic Epilepsy, Squamous cell carcinoma of esophagus, Poikiloderma of Kindler, pretibial Epidermolysis bullosa, Dominant dystrophic epidermolysis bullosa albopapular type (disorder), Localized recessive dystrophic epidermolysis bullosa, Generalized dystrophic epidermolysis bullosa, Squamous cell carcinoma of skin, Epidermolysis Bullosa Pruriginosa, Mammary Neoplasms, Epidermolysis Bullosa Simplex Superficialis, Isolated Toenail Dystrophy, Transient bullous dermolysis of the newborn, Autosomal Recessive Epidermolysis Bullosa Dystrophica Localisata Variant, and Autosomal Recessive Epidermolysis Bullosa Dystrophica Inversa.

In some embodiments, the disease is acute myeloid leukemia (AML), targeting Wilms Tumor I (WTI) and HLA expressing cells. In embodiments, the therapy is T cell therapy, as described elsewhere herein, comprising engineered T cells with WTI specific TCRs. In certain embodiments, the target is CD157 in AML.

In embodiments, the disease is a blood disease. In certain embodiments, the disease is hemophilia, in one aspect the target is Factor XI. In other embodiments, the disease is a hemoglobinopathy, such as sickle cell disease, sickle cell trait, hemoglobin C disease, hemoglobin C trait, hemoglobin S/C disease, hemoglobin D disease, hemoglobin E disease, a thalassemia, a condition associated with hemoglobin with increased oxygen affinity, a condition associated with hemoglobin with decreased oxygen affinity, unstable hemoglobin disease, methemoglobinemia. Hemostasis and Factor X and XII deficiencies can also be treated. In embodiments, the target is BCL11A gene (e.g., a human BCL11a gene), a BCL11a enhancer (e.g., a human BCL11a enhancer), or a HFPH region (e.g., a human HPFH region), beta globulin, fetal hemoglobin, γ-globin genes (e.g., HBG1, HBG2, or HBG1 and HBG2), the erythroid specific enhancer of the BCL11A gene (BCL11Ae), or a combination thereof.

In embodiments, the target locus can be one or more of RAC, TRBC1, TRBC2, CD3E, CD3G, CD3D, B2M, CIITA, CD247, HLA-A, HLA-B, HLA-C, DCK, CD52, FKBP1A, NLRC5, RFXANK, RFX5, RFXAP, NR3C1, CD274, HAVCR2, LAG3, PDCD1, PD-L2, HCF2, PAI, TFPI, PLAT, PLAU, PLG, RPOZ, F7, F8, F9, F2, F5, F7, F10, F11, F12, F13A1, F13B, STAT1, FOXP3, IL2RG, DCLRE1C, ICOS, MHC2TA, GALNS, HGSNAT, ARSB, RFXAP, CD20, CD81, TNFRSF13B, SEC23B, PKLR, IFNG, SPTB, SPTA, SLC4A1, EPO, EPB42, CSF2 CSF3, VFW, SERPINCA1, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MHC class I, MHC class II, GALS, adenosine, and TGF beta, PTPN11, and combinations thereof. In embodiments, the target sequence within the genomic nucleic acid sequence at Chr1 1:5,250,094-5,250,237, -strand, hg38; Chr1 1:5,255,022-5,255,164, -strand, hg38; nondeletional HFPH region; Chr1 1:5,249,833 to Chr1 1:5,250,237, -strand, hg38; Chr1 1:5,254,738 to Chr1 1:5,255, 164, -strand, hg38; Chr1 1: 5,249,833-5,249,927, -strand, hg3; Chr1 1: 5,254,738-5,254, 851, -strand, hg38; Chr1 1:5,250, 139-5,250,237, -strand, hg38.

In some embodiments, the disease is associated with high cholesterol, and regulation of cholesterol is provided, in some embodiments, regulation is effected by modification in the target PCSK9. Other diseases in which PCSK9 can be implicated, and thus would be a target for the systems and methods described herein include Abetaiipoproteinemia, Adenoma, Arteriosclerosis, Atherosclerosis, Cardiovascular Diseases, Cholelithiasis, Coronary Arteriosclerosis, Coronary heart disease, Non-Insulin-Dependent Diabetes Melii-tus, Hypercholesterolemia, Familial Hypercholesterolemia, Hyperinsuiinism, Hyperlipidemia, Familial Combined Hyperlipidemia, Hypobetalipoproteinemias, Chronic Kidney Failure, Liver diseases, Liver neoplasms, melanoma, Myocardial Infarction, Narcolepsy, Neoplasm Metastasis, Nephroblastoma, Obesity, Peritonitis, Pseudoxanthoma Elasticum, Cerebrovascular accident, Vascular Diseases, Xanthomatosis, Peripheral Vascular Diseases, Myocardial Ischemia, Dyslipidemias, Impaired glucose tolerance, Xanthoma, Polygenic hypercholesterolemia, Secondary malignant neoplasm of liver, Dementia, Overweight, Hepatitis C, Chronic, Carotid Atherosclerosis, Hyperlipoproteinemia Type Ha, Intracranial Atherosclerosis, Ischemic stroke, Acute Coronary Syndrome, Aortic calcification, Cardiovascular morbidity, Hyperlipoproteinemia Type lib, Peripheral Arterial Diseases, Familial Hyperaldosteronism Type II, Familial hypobetalipoproteinemia, Autosomal Recessive Hypercholesterolemia, Autosomal Dominant Hypercholesterolemia 3, Coronary Artery Disease, Liver carcinoma, Ischemic Cerebrovascular Accident, and Arteriosclerotic cardiovascular disease NOS. In embodiments, the treatment can be targeted to the liver, the primary location of activity of PCSK9.

In some embodiments, the disease or disorder is Hyper IGM syndrome or a disorder characterized by defective CD40 signaling. In certain embodiments, the insertion of CD40L exons are used to restore proper CD40 signaling and B cell class switch recombination. In particular embodiments, the target is CD40 ligand (CD40L)-edited at one or more of exons 2-5 of the CD40L gene, in cells, e.g., T cells or hematopoietic stem cells (HSCs).

In some embodiments, the disease is merosin-deficient congenital muscular dystrophy (mdcmd) and other laminin, alpha 2 (lama2) gene related conditions or disorders. The therapy can be targeted to the muscle, for example, skeletal muscle, smooth muscle, and/or cardiac muscle. In certain embodiments, the target is Laminin, Alpha 2 (LAMA2) which may also be referred to as Laminin-12 Subunit Alpha, Laminin-2 Subunit Alpha, Laminin-4 Subunit Alpha 3, Merosin Heavy Chain, Laminin M Chain, LAMM, Congenital Muscular Dystrophy and Merosin. LAMA2 has a cytogenetic location of 6q22.33 and the genomic coordinate are on Chromosome 6 on the forward strand at position 128,883, 141-129,516,563. In embodiments, the disease treated can be Merosin-Deficient Congenital Muscular Dystrophy (MDCMD), Amyotrophic Lateral Sclerosis, Bladder Neoplasm, Charcot-Marie-Tooth Disease, Colorectal Carcinoma, Contracture, Cyst, Duchenne Muscular Dystrophy, Fatigue, Hyperopia, Renovascular Hypertension, melanoma, Mental Retardation, Myopathy, Muscular Dystrophy, Myopia, Myositis, Neuromuscular Diseases, Peripheral Neuropathy, Refractive Errors, Schizophrenia, Severe mental retardation (I.Q. 20-34), Thyroid Neoplasm, Tobacco Use Disorder, Severe Combined Immunodeficiency, Synovial Cyst, Adenocarcinoma of lung (disorder), Tumor Progression, Strawberry nevus of skin, Muscle degeneration, Microdontia (disorder), Walker-Warburg congenital muscular dystrophy, Chronic Periodontitis, Leukoencephalopathies, Impaired cognition, Fukuyama Type Congenital Muscular Dystrophy, Scleroatonic muscular dystrophy, Eichsfeld type congenital muscular dystrophy, Neuropathy, Muscle eye brain disease, Limb-Muscular Dystrophies, Girdle, Congenital muscular dystrophy (disorder), Muscle fibrosis, cancer recurrence, Drug Resistant Epilepsy, Respiratory Failure, Myxoid cyst, Abnormal breathing, Muscular dystrophy congenital merosin negative, Colorectal Cancer, Congenital Muscular Dystrophy due to Partial LAMA2 Deficiency, and Autosomal Dominant Craniometaphyseal Dysplasia.

In certain embodiments, the target is an AAVS1 (PPPIR12C), an ALB gene, an Angptl3 gene, an ApoC3 gene, an ASGR2 gene, a CCR5 gene, a FIX (F9) gene, a G6PC gene, a Gys2 gene, an HGD gene, a Lp(a) gene, a Pcsk9 gene, a Serpinal gene, a TF gene, and a TTR gene). Assessment of efficiency of HDR/NHEJ mediated knock-in of cDNA into the first exon can utilize cDNA knock-in into "safe harbor" sites such as: single-stranded or double-stranded DNA having homologous arms to one of the following regions, for example: ApoC3 (chr11:116829908-116833071), Angptl3 (chr1:62,597,487-62,606,305), Serpinal (chr14:94376747-94390692), Lp(a) (chr6:160531483-160664259), Pcsk9 (chr1:55,039,475-55,064,852), FIX (chrX:139,530,736-139,563,458), ALB (chr4:73,404,254-73,421,411), TTR (chr1 8:31,591,766-31,599,023), TF (chr3:133,661,997-133,779,005), G6PC (chr17:42,900,796-42,914,432), Gys2 (chr12:21,536,188-21,604,857), AAVS1 (PPP1R12C) (chr19:55,090,912-55,117,599), HGD (chr3:120,628,167-120,682,570), CCR5 (chr3:46,370,854-46,376,206), or ASGR2 (chr17:7,101,322-7,114,310).

In one aspect, the target is superoxide dismutase 1, soluble (SOD1), which can aid in treatment of a disease or disorder associated with the gene. In particular embodiments, the disease or disorder is associated with SOD1, and can be, for example, Adenocarcinoma, Albuminuria, Chronic Alcoholic Intoxication, Alzheimer's Disease, Amnesia, Amyloidosis, Amyotrophic Lateral Sclerosis, Anemia, Autoimmune hemolytic anemia, Sickle Cell Anemia, Anoxia, Anxiety Disorders, Aortic Diseases, Arteriosclerosis, Rheumatoid Arthritis, Asphyxia Neonatorum, Asthma, Atherosclerosis, Autistic Disorder, Autoimmune Diseases, Barrett Esophagus, Behcet Syndrome, Malignant neoplasm of urinary bladder, Brain Neoplasms, Malignant neoplasm of breast, Oral candidiasis, Malignant tumor of colon, Bronchogenic Carcinoma, Non-Small Cell Lung Carcinoma, Squamous cell carcinoma, Transitional Cell Carcinoma, Cardiovascular Diseases, Carotid Artery Thrombosis, Neoplastic Cell Transformation, Cerebral Infarction, Brain Ischemia, Transient Ischemic Attack, Charcot-Marie-Tooth Disease, Cholera, Colitis, Colorectal Carcinoma, Coronary Arteriosclerosis, Coronary heart disease, Infection by *Cryptococcus neoformans*, Deafness, Cessation of life, Deglutition Disorders, Presenile dementia, Depressive disorder, Contact Dermatitis, Diabetes, Diabetes Mellitus, Experimental Diabetes Mellitus, Insulin-Dependent Diabetes Mellitus, Non-Insulin-Dependent Diabetes Mellitus, Diabetic Angiopathies, Diabetic Nephropathy, Diabetic Retinopathy, Down Syndrome, Dwarfism, Edema, Japanese Encephalitis, Toxic Epidermal Necrolysis, Temporal Lobe Epilepsy, Exanthema, Muscular fasciculation, Alcoholic Fatty Liver, Fetal Growth Retardation, Fibromyalgia, Fibrosarcoma, Fragile X Syndrome, Giardiasis, Glioblastoma, Glioma, Headache, Partial Hearing Loss, Cardiac Arrest, Heart failure, Atrial Septal Defects, Helminthiasis, Hemochromatosis, Hemolysis (disorder), Chronic Hepatitis, HIV Infections, Huntington Disease, Hypercholesterolemia, Hyperglycemia, Hyperplasia, Hypertensive disease, Hyperthyroidism, Hypopituitarism, Hypoproteinemia, Hypotension, natural Hypothermia, Hypothyroidism, Immunologic Deficiency Syndromes, Immune System Diseases, Inflammation, Inflammatory Bowel Diseases, Influenza, Intestinal Diseases, Ischemia, Kearns-Sayre syndrome, Keratoconus, Kidney Calculi, Kidney Diseases, Acute Kidney Failure, Chronic Kidney Failure, Polycystic Kidney Diseases, leukemia, Myeloid Leukemia, Acute Promyelocytic Leukemia, Liver Cirrhosis, Liver diseases, Liver neoplasms, Locked-In Syndrome, Chronic Obstructive Airway Disease, Lung Neoplasms, Systemic Lupus Erythematosus, Non-Hodgkin Lymphoma, Machado-Joseph Disease, Malaria, Malignant neoplasm of stomach, Animal Mammary Neoplasms, Marfan Syndrome, Meningomyelocele, Mental Retardation, Mitral Valve Stenosis, Acquired Dental Fluorosis, Movement Disorders, Multiple Sclerosis, Muscle Rigidity, Muscle Spasticity, Muscular Atrophy, Spinal Muscular Atrophy, Myopathy, Mycoses, Myocardial Infarction, Myocardial Reperfusion Injury, Necrosis, Nephrosis, Nephrotic Syndrome, Nerve Degeneration, nervous system disorder, Neuralgia, Neuroblastoma, Neuroma, Neuromuscular Diseases, Obesity, Occupational Diseases, Ocular Hypertension, Oligospermia, Degenerative polyarthritis, Osteoporosis, Ovarian Carcinoma, Pain, Pancreatitis, Papillon-Lefevre Disease, Paresis, Parkinson Disease, Phenylketonurias, Pituitary Diseases, Pre-Eclampsia, Prostatic Neoplasms, Protein Deficiency, Proteinuria, Psoriasis, Pulmonary Fibrosis, Renal Artery Obstruction, Reperfusion Injury, Retinal Degeneration, Retinal Diseases, Retinoblastoma, Schistosomiasis, Schistosomiasis *mansoni*, Schizophrenia, Scrapie, Seizures, Age-related cataract, Compression of spinal cord, Cerebrovascular accident, Subarachnoid Hemorrhage, Progressive supranuclear palsy, Tetanus, Trisomy, Turner Syndrome, Unipolar Depression, Urticaria, Vitiligo, Vocal Cord Paralysis, Intestinal *Volvulus*, Weight Gain, HMN (Hereditary Motor Neuropathy) Proximal Type I, Holoprosencephaly, Motor Neuron Disease, Neurofibrillary degeneration (morphologic abnormality), Burning sensation, Apathy, Mood swings, Synovial Cyst, Cataract, Migraine Disorders, Sciatic Neuropathy, Sensory neuropathy, Atrophic condition of skin, Muscle Weakness, Esophageal carcinoma, Lingual-Facial-Buccal Dyskinesia, Idiopathic pulmonary hypertension, Lateral Sclerosis, Migraine with Aura, Mixed Conductive-Sensorineural Hearing Loss, Iron deficiency anemia, Malnutrition, Prion Diseases, Mitochondrial Myopathies, MELAS Syndrome, Chronic progressive external ophthalmoplegia, General Paralysis, Premature aging syndrome, Fibrillation, Psychiatric symptom, Memory impairment, Muscle degeneration, Neurologic Symptoms, Gastric hemorrhage, Pancreatic carcinoma, Pick Disease of the Brain, Liver Fibrosis, Malignant neoplasm of lung, Age related macular degeneration, Parkinsonian Disorders, Disease Progression, Hypocupremia, Cytochrome-c Oxidase Deficiency, Essential Tremor, Familial Motor Neuron Disease, Lower Motor Neuron Disease, Degenerative myelopathy, Diabetic Polyneuropathies, Liver and Intrahepatic Biliary Tract Carcinoma, Persian Gulf Syndrome, Senile Plaques, Atrophic, Frontotemporal dementia, Semantic Dementia, Common Migraine, Impaired cognition, Malignant neoplasm of liver, Malignant neoplasm of pancreas, Malignant neoplasm of prostate, Pure Autonomic Failure, Motor symptoms, Spastic, Dementia, Neurodegenerative Disorders, Chronic Hepatitis C, Guam Form Amyotrophic Lateral Sclerosis, Stiff limbs, Multisystem disorder, Loss of scalp hair, Prostate carcinoma, Hepatopulmonary Syndrome, Hashimoto Disease, Progressive Neoplastic Disease, Breast Carcinoma, Terminal illness, Carcinoma of lung, Tardive Dyskinesia, Secondary malignant neoplasm of lymph node, Colon Carcinoma, Stomach Carcinoma, Central neuroblastoma, Dissecting aneurysm of the thoracic aorta, Diabetic macular edema, Microalbuminuria, Middle Cerebral Artery Occlusion, Middle Cerebral Artery Infarction, Upper motor neuron signs, Frontotemporal Lobar Degeneration, Memory Loss, Classical phenylketonuria, CADASIL Syndrome, Neurologic Gait Disorders, Spinocerebellar Ataxia Type 2, Spinal Cord Ischemia, Lewy Body Disease, Muscular Atrophy, Spinobulbar, Chromosome 21 monosomy, Thrombocytosis, Spots on skin, Drug-Induced Liver Injury, Hereditary Leber Optic Atrophy, Cerebral Ischemia, ovarian neoplasm, Tauopathies, Macroangiopathy, Persistent pulmonary hypertension, Malignant neoplasm of ovary, Myxoid cyst, Drusen, Sarcoma, Weight decreased, Major Depressive Disorder, Mild cognitive disorder, Degenerative disorder, Partial Trisomy, Cardiovascular morbidity, hearing impairment, Cognitive changes, Ureteral Calculi, Mammary Neoplasms, Colorectal Cancer, Chronic Kidney Diseases, Minimal Change Nephrotic Syndrome, Non-Neoplastic Disorder, X-Linked Bulbo-Spinal Atrophy, Mammographic Density, Normal Tension Glaucoma Susceptibility To Finding), Vitiligo-Associated Multiple Autoimmune Disease Susceptibility 1 (Finding), Amyotrophic Lateral Sclerosis And/Or Frontotemporal Dementia 1, Amyotrophic Lateral Sclerosis 1, Sporadic Amyotrophic Lateral Sclerosis, monomelic Amyotrophy, Coronary Artery Disease, Transformed migraine, Regurgitation, Urothelial Carcinoma, Motor disturbances, Liver carcinoma, Protein Misfolding Disorders, TDP-43 Proteinopathies, Promyelocytic leukemia, Weight Gain Adverse Event, Mitochondrial cytopathy, Idiopathic pulmonary arterial hypertension, Progressive cGVHD, Infection, GRN-related frontotemporal dementia, Mitochondrial pathology, and Hearing Loss.

In particular embodiments, the disease is associated with the gene ATXN1, ATXN2, or ATXN3, which may be targeted for treatment. In some embodiments, the CAG repeat region located in exon 8 of ATXN1, exon 1 of ATXN2, or exon 10 of the ATXN3 is targeted. In embodiments, the disease is spinocerebellar ataxia 3 (sca3), sca1, or sca2 and other related disorders, such as Congenital Abnormality, Alzheimer's Disease, Amyotrophic Lateral Sclerosis, Ataxia, Ataxia Telangiectasia, Cerebellar Ataxia, Cerebellar Diseases, Chorea, Cleft Palate, Cystic Fibrosis, Mental Depression, Depressive disorder, Dystonia, Esophageal Neoplasms, Exotropia, Cardiac Arrest, Huntington Disease, Machado-Joseph Disease, Movement Disorders, Muscular Dystrophy, Myotonic Dystrophy, Narcolepsy, Nerve Degeneration, Neuroblastoma, Parkinson Disease, Peripheral Neuropathy, Restless Legs Syndrome, Retinal Degeneration, Retinitis Pigmentosa, Schizophrenia, Shy-Drager Syndrome, Sleep disturbances, Hereditary Spastic Paraplegia, Thromboembolism, Stiff-Person Syndrome, Spinocerebellar Ataxia, Esophageal carcinoma, Polyneuropathy, Effects of heat, Muscle twitch, Extrapyramidal sign, Ataxic, Neurologic Symptoms, Cerebral atrophy, Parkinsonian Disorders, Protein S Deficiency, Cerebellar degeneration, Familial Amyloid Neuropathy Portuguese Type, Spastic syndrome, Vertical Nystagmus, Nystagmus End-Position, Antithrombin III Deficiency, Atrophic, Complicated hereditary spastic paraplegia, Multiple System Atrophy, Pallidoluysian degeneration, Dystonia Disorders, Pure Autonomic Failure, Thrombophilia, Protein C, Deficiency, Congenital Myotonic Dystrophy, Motor symptoms, Neuropathy, Neurodegenerative Disorders, Malignant neoplasm of esophagus, Visual disturbance, Activated Protein C Resistance, Terminal illness, Myokymia, Central neuroblastoma, Dyssomnias, Appendicular Ataxia, Narcolepsy-Cataplexy Syndrome, Machado-Joseph Disease Type I, Machado-Joseph Disease Type II, Machado-Joseph Disease Type III, Dentatorubral-Pallidoluysian Atrophy, Gait Ataxia, Spinocerebellar Ataxia Type 1, Spinocerebellar Ataxia Type 2, Spinocerebellar Ataxia Type 6 (disorder), Spinocerebellar Ataxia Type 7, Muscular Spinobulbar Atrophy, Genomic Instability, Episodic ataxia type 2 (disorder), Bulbo-Spinal Atrophy X-Linked, Fragile X Tremor/Ataxia Syndrome, Thrombophilia Due to Activated Protein C Resistance (Disorder), Amyotrophic Lateral Sclerosis 1, Neuronal Intranuclear Inclusion Disease, Hereditary Antithrombin Iii Deficiency, and Late-Onset Parkinson Disease.

In some embodiments, the disease is associated with expression of a tumor antigen-cancer or non-cancer related indication, for example acute lymphoid leukemia, diffuse large B cell lymphoma, follicular lymphoma, chronic lymphocytic leukemia, Hodgkin lymphoma, non-Hodgkin lymphoma. In embodiments, the target can be TET2 intron, a TET2 intron-exon junction, a sequence within a genomic region of chr4.

In some embodiments, neurodegenerative diseases can be treated. In particular embodiments, the target is Synuclein, Alpha (SNCA). In certain embodiments, the disorder treated is a pain related disorder, including congenital pain insensitivity, Compressive Neuropathies, Paroxysmal Extreme Pain Disorder, High grade atrioventricular block, Small Fiber Neuropathy, and Familial Episodic Pain Syndrome 2.

In certain embodiments, the target is Sodium Channel, Voltage Gated, Type X Alpha Subunit (SCN1OA).

In certain embodiments, hematopoetic stem cells and progenitor stem cells are edited, including knock-ins. In particular embodiments, the knock-in is for treatment of lysosomal storage diseases, glycogen storage diseases, mucopolysaccharoidoses, or any disease in which the secretion of a protein will ameliorate the disease. In one embodiment, the disease is sickle cell disease (SCD). In another embodiment, the disease is β-thalessemia.

In certain embodiments, the T cell or NK cell is used for cancer treatment and may include T cells comprising the recombinant receptor (e.g. CAR) and one or more phenotypic markers selected from CCR7+, 4-1BB+(CD137+), TIM3+, CD27+, CD62L+, CD127+, CD45RA+, CD45RO−, t-bet1'w, IL-7Ra+, CD95+, IL-2RP+, CXCR3+ or LFA-1+. In certain embodiments the editing of a T cell for cancer immunotherapy comprises altering one or more T-cell expressed gene, e.g., one or more of FAS, BID, CTLA4, PDCD1, CBLB, PTPN6, B2M, TRAC and TRBC gene. In some embodiments, editing includes alterations introduced into, or proximate to, the CBLB target sites to reduce CBLB gene expression in T cells for treatment of proliferative diseases and may include larger insertions or deletions at one or more CBLB target sites. T cell editing of TGFBR2 target sequence can be, for example, located in exon 3, 4, or 5 of the TGFBR2 gene and utilized for cancers and lymphoma treatment.

Cells for transplantation can be edited and may include allele-specific modification of one or more immunogenicity genes (e.g., an HLA gene) of a cell, e.g., HLA-A, HLA-B, HLA-C, HLA-DRB1, HLA-DRB3/4/5, HLA-DQ, and HLA-DP MiHAs, and any other MHC Class I or Class II genes or loci, which may include delivery of one or more matched recipient HLA alleles into the original position(s) where the one or more mismatched donor HLA alleles are located, and may include inserting one or more matched recipient HLA alleles into a "safe harbor" locus. In an embodiment, the method further includes introducing a chemotherapy resistance gene for in vivo selection in a gene.

Methods and systems can target Dystrophia Myotonica-Protein Kinase (DMPK) for editing, in particular embodiments, the target is the CTG trinucleotide repeat in the 3' untranslated region (UTR) of the DMPK gene. Disorders or diseases associated with DMPK include Atherosclerosis, Azoospermia, Hypertrophic Cardiomyopathy, Celiac Disease, Congenital chromosomal disease, Diabetes Mellitus, Focal glomerulosclerosis, Huntington Disease, Hypogonadism, Muscular Atrophy, Myopathy, Muscular Dystrophy, Myotonia, Myotonic Dystrophy, Neuromuscular Diseases, Optic Atrophy, Paresis, Schizophrenia, Cataract, Spinocerebellar Ataxia, Muscle Weakness, Adrenoleukodystrophy, Centronuclear myopathy, Interstitial fibrosis, myotonic muscular dystrophy, Abnormal mental state, X-linked Charcot-Marie-Tooth disease 1, Congenital Myotonic Dystrophy, Bilateral cataracts (disorder), Congenital Fiber Type Disproportion, Myotonic Disorders, Multisystem disorder, 3-Methylglutaconic aciduria type 3, cardiac event, Cardiogenic Syncope, Congenital Structural Myopathy, Mental handicap, Adrenomyeloneuropathy, Dystrophia myotonica 2, and Intellectual Disability.

In some embodiments, the disease is an inborn error of metabolism. The disease may be selected from Disorders of Carbohydrate Metabolism (glycogen storage disease, G6PD deficiency), Disorders of Amino Acid Metabolism (phenylketonuria, maple syrup urine disease, glutaric acidemia type 1), Urea Cycle Disorder or Urea Cycle Defects (carbamoyl phosphate synthease I deficiency), Disorders of Organic Acid Metabolism (alkaptonuria, 2-hydroxyglutaric acidurias), Disorders of Fatty Acid Oxidation/Mitochondrial Metabolism (Medium-chain acyl-coenzyme A dehydrogenase deficiency), Disorders of Porphyrin metabolism (acute intermittent *porphyria*), Disorders of Purine/Pyrimidine Metabolism (Lesch-Nynan syndrome), Disorders of Steroid Metabolism (lipoid congenital adrenal hyperplasia, congenital adrenal hyperplasia), Disorders of Mitochondrial Function (Kearns-Sayre syndrome), Disorders of Peroxisomal function (Zellweger syndrome), or Lysosomal Storage Disorders (Gaucher's disease, Niemann-Pick disease).

In some embodiments, the target can comprise Recombination Activating Gene 1 (RAG1), BCL11 A, PCSK9, laminin, alpha 2 (lama2), ATXN3, alanine-glyoxylate aminotransferase (AGXT), collagen type vii alpha 1 chain (COL7a1), spinocerebellar ataxia type 1 protein (ATXN1), Angiopoietin-like 3 (ANGPTL3), Frataxin (FXN), Superoxidase Dismutase 1, soluble (SOD1), Synuclein, Alpha (SNCA), Sodium Channel, Voltage Gated, Type X Alpha Subunit (SCN10A), Spinocerebellar Ataxia Type 2 Protein (ATXN2), Dystrophia Myotonica-Protein Kinase (DMPK), beta globin locus on chromosome 11, acyl-coenzyme A dehydrogenase for medium chain fatty acids (ACADM), long-chain 3-hydroxyl-coenzyme A dehydrogenase for long chain fatty acids (HADHA), acyl-coenzyme A dehydrogenase for very long-chain fatty acids (ACADVL), Apolipoprotein C3 (APOCIII), Transthyretin (TTR), Angiopoietin-like 4 (ANGPTL4), Sodium Voltage-Gated Channel Alpha Subunit 9 (SCN9A), Interleukin-7 receptor (IL7R), glucose-6-phosphatase, catalytic (G6PC), haemochromatosis (HFE), SERPINA1, C9ORF72, β-globin, dystrophin, γ-globin.

In certain embodiments, the disease or disorder is associated with Apolipoprotein C3 (APOCIII), which can be targeted for editing. In embodiments, the disease or disorder may be Dyslipidemias, Hyperalphalipoproteinemia Type 2, Lupus Nephritis, Wilms Tumor 5, Morbid obesity and spermatogenic, Glaucoma, Diabetic Retinopathy, Arthrogryposis renal dysfunction cholestasis syndrome, Cognition Disorders, Altered response to myocardial infarction, Glucose Intolerance, Positive regulation of triglyceride biosynthetic process, Renal Insufficiency, Chronic, Hyperlipidemias, Chronic Kidney Failure, Apolipoprotein C-III Deficiency, Coronary Disease, Neonatal Diabetes Mellitus, Neonatal, with Congenital Hypothyroidism, Hypercholesterolemia Autosomal Dominant 3, Hyperlipoproteinemia Type III, Hyperthyroidism, Coronary Artery Disease, Renal Artery Obstruction, Metabolic Syndrome X, Hyperlipidemia, Familial Combined, Insulin Resistance, Transient infantile hypertriglyceridemia, Diabetic Nephropathies, Diabetes Mellitus (Type 1), Nephrotic Syndrome Type 5 with or without ocular abnormalities, and Hemorrhagic Fever with renal syndrome.

In certain embodiments, the target is Angiopoietin-like 4(ANGPTL4). Diseases or disorders associated with ANGPTL4 that can be treated include ANGPTL4 is associated with dyslipidemias, low plasma triglyceride levels, regulator of angiogenesis and modulate tumorigenesis, and severe diabetic retinopathy. both proliferative diabetic retinopathy and non-proliferative diabetic retinopathy.

In some embodiments, editing can be used for the treatment of fatty acid disorders. In certain embodiments, the target is one or more of ACADM, HADHA, ACADVL. In embodiments, the targeted edit is the activity of a gene in a cell selected from the acyl-coenzyme A dehydrogenase for medium chain fatty acids (ACADM) gene, the long-chain 3-hydroxyl-coenzyme A dehydrogenase for long chain fatty acids (HADHA) gene, and the acyl-coenzyme A dehydrogenase for very long-chain fatty acids (ACADVL) gene. In one aspect, the disease is medium chain acyl-coenzyme A dehydrogenase deficiency (MCADD), long-chain 3-hydroxyl-coenzyme A dehydrogenase deficiency (LCHADD), and/or very long-chain acyl-coenzyme A dehydrogenase deficiency (VLCADD).

Treating Pathogens, Like Viral Pathogens Such as HIV

Cas-mediated genome editing might be used to introduce protective mutations in somatic tissues to combat nongenetic or complex diseases. For example, NHEJ-mediated inactivation of the CCR5 receptor in lymphocytes (Lombardo et al., Nat Biotechnol. 2007 November; 25(11):1298-306) may be a viable strategy for circumventing HIV infection, whereas deletion of PCSK9 (Cohen et al., Nat Genet. 2005 February; 37(2):161-5) orangiopoietin (Musunuru et al., N Engl J Med. 2010 Dec. 2; 363(23):2220-7) may provide therapeutic effects against statin-resistant hypercholesterolemia or hyperlipidemia. Although these targets may be also addressed using siRNA-mediated protein knockdown, a unique advantage of NHEJ-mediated gene inactivation is the ability to achieve permanent therapeutic benefit without the need for continuing treatment. As with all gene therapies, it will of course be important to establish that each proposed therapeutic use has a favorable benefit-risk ratio.

Hydrodynamic delivery of plasmid DNA encoding Cas9 and guide RNA along with a repair template into the liver of an adult mouse model of tyrosinemia was shown to be able to correct the mutant Fah gene and rescue expression of the wild-type Fah protein in ~1 out of 250 cells (Nat Biotechnol. 2014 June; 32(6):551-3). In addition, clinical trials successfully used ZF nucleases to combat HIV infection by ex vivo knockout of the CCR5 receptor. In all patients, HIV DNA levels decreased, and in one out of four patients, HIV RNA became undetectable (Tebas et al., N Engl J Med. 2014 Mar. 6; 370(10):901-10). Both of these results demonstrate the promise of programmable nucleases as a new therapeutic platform.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the system of the present invention. A minimum of 2.5×106 CD34+ cells per kilogram patient weight may be collected and prestimulated for 16 to 20 hours in X-VIVO 15 medium (Lonza) containing 2 µmol/L-glutamine, stem cell factor (100 ng/ml), Flt-3 ligand (Flt-3L) (100 ng/ml), and thrombopoietin (10 ng/ml) (CellGenix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin, Takara Bio Inc.).

With the knowledge in the art and the teachings in this disclosure the skilled person can correct HSCs as to immunodeficiency condition such as HIV/AIDS comprising contacting an HSC with a Type V CRISPR system that targets and knocks out CCR5. An guide RNA (and advantageously a dual guide approach, e.g., a pair of different guide RNAs; for instance, guide RNAs targeting of two clinically relevant genes, B2M and CCR5, in primary human CD4+ T cells and CD34+ hematopoietic stem and progenitor cells (HSPCs)) that targets and knocks out CCR5-and-Type V effector containing particle is contacted with HSCs. The so contacted cells can be administered; and optionally treated/expanded; cf. Cartier. See also Kiem, "Hematopoietic stem cell-based gene therapy for HIV disease," Cell Stem Cell. Feb. 3, 2012; 10(2): 137-147; incorporated herein by reference along with the documents it cites; Mandal et al, "Efficient Ablation of Genes in Human Hematopoietic Stem and Effector Cells using CRISPR/Cas9," Cell Stem Cell, Volume 15, Issue 5, p 643-652, 6 Nov. 2014; incorporated herein by reference along with the documents it cites. Mention is also made of Ebina, "CRISPR/Cas9 system to suppress HIV-1 expression by editing HIV-1 integrated proviral DNA" SCIENTIFIC REPORTS|3: 2510|DOI: 10.1038/srep02510, incorporated herein by reference along with the documents it cites, as another means for combatting HIV/AIDS using a CRISPR-Type V effector system.

The rationale for genome editing for HIV treatment originates from the observation that individuals homozygous for loss of function mutations in CCR5, a cellular co-receptor for the virus, are highly resistant to infection and otherwise healthy, suggesting that mimicking this mutation with genome editing could be a safe and effective therapeutic strategy [Liu, R., et al. Cell 86, 367-377 (1996)]. This idea was clinically validated when an HIV infected patient was given an allogeneic bone marrow transplant from a donor homozygous for a loss of function CCR5 mutation, resulting in undetectable levels of HIV and restoration of normal CD4 T-cell counts [Hutter, G., et al. The New England journal of medicine 360, 692-698 (2009)]. Although bone marrow transplantation is not a realistic treatment strategy for most HIV patients, due to cost and potential graft vs. host disease, HIV therapies that convert a patient's own T-cells into CCR5 are desirable.

Early studies using ZFNs and NHEJ to knockout CCR5 in humanized mouse models of HIV showed that transplantation of CCR5 edited CD4 T cells improved viral load and CD4 T-cell counts [Perez, E. E., et al. Nature biotechnology 26, 808-816 (2008)]. Importantly, these models also showed that HIV infection resulted in selection for CCR5 null cells, suggesting that editing confers a fitness advantage and potentially allowing a small number of edited cells to create a therapeutic effect.

As a result of this and other promising preclinical studies, genome editing therapy that knocks out CCR5 in patient T cells has now been tested in humans [Holt, N., et al. Nature biotechnology 28, 839-847 (2010); Li, L., et al. Molecular therapy: the journal of the American Society of Gene Therapy 21, 1259-1269 (2013)]. In a recent phase I clinical trial, CD4+ T cells from patients with HIV were removed, edited with ZFNs designed to knockout the CCR5 gene, and autologously transplanted back into patients [Tebas, P., et al. The New England journal of medicine 370, 901-910 (2014)].

In another study (Mandal et al., Cell Stem Cell, Volume 15, Issue 5, p 643-652, 6 Nov. 2014), CRISPR-Cas9 has targeted two clinical relevant genes, B2M and CCR5, in human CD4+ T cells and CD34+ hematopoietic stem and progenitor cells (HSPCs). Use of single RNA guides led to highly efficient mutagenesis in HSPCs but not in T cells. A dual guide approach improved gene deletion efficacy in both cell types. HSPCs that had undergone genome editing with CRISPR-Cas9 retained multilineage potential. Predicted on- and off-target mutations were examined via target capture sequencing in HSPCs and low levels of off-target mutagenesis were observed at only one site. These results demonstrate that CRISPR-Cas9 can efficiently ablate genes in HSPCs with minimal off-target mutagenesis, which have broad applicability for hematopoietic cell-based therapy.

Wang et al. (PLoS One. 2014 Dec. 26; 9(12):e115987. doi: 10.1371/journal.pone.0115987) silenced CCR5 via CRISPR associated protein 9 (Cas9) and single guided RNAs (guide RNAs) with lentiviral vectors expressing Cas9 and CCR5 guide RNAs. Wang et al. showed that a single round transduction of lentiviral vectors expressing Cas9 and CCR5 guide RNAs into HIV-1 susceptible human CD4+ cells yields high frequencies of CCR5 gene disruption. CCR5 gene-disrupted cells are not only resistant to R5-tropic HIV-1, including transmitted/founder (T/F) HIV-1 isolates, but also have selective advantage over CCR5 gene-undisrupted cells during R5-tropic HIV-1 infection. Genome mutations at potential off-target sites that are highly homologous to these CCR5 guide RNAs in stably transduced cells even at 84 days post transduction were not detected by a T7 endonuclease I assay.

Fine et al. (Sci Rep. 2015 Jul. 1; 5:10777. doi: 10.1038/srep10777) identified a two-cassette system expressing pieces of the S. pyogenes Cas9 (SpCas9) protein which splice together in cellula to form a functional protein capable of site-specific DNA cleavage. With specific CRISPR guide strands, Fine et al. demonstrated the efficacy of this system in cleaving the HBB and CCR5 genes in human HEK-293T cells as a single Cas9 and as a pair of Cas9 nickases. The trans-spliced SpCas9 (tsSpCas9) displayed ~35% of the nuclease activity compared with the wild-type SpCas9 (wt-SpCas9) at standard transfection doses, but had substantially decreased activity at lower dosing levels. The greatly reduced open reading frame length of the tsSpCas9 relative to wtSpCas9 potentially allows for more complex and longer genetic elements to be packaged into an AAV vector including tissue-specific promoters, multiplexed guide RNA expression, and effector domain fusions to SpCas9.

Li et al. (J Gen Virol. 2015 August; 96(8):2381-93. doi: 10.1099/vir.0.000139. Epub 2015 Apr. 8) demonstrated that CRISPR-Cas9 can efficiently mediate the editing of the CCR5 locus in cell lines, resulting in the knockout of CCR5 expression on the cell surface. Next-generation sequencing revealed that various mutations were introduced around the predicted cleavage site of CCR5. For each of the three most effective guide RNAs that were analyzed, no significant off-target effects were detected at the 15 top-scoring potential sites. By constructing chimeric Ad5F35 adenoviruses carrying CRISPR-Cas9 components, Li et al. efficiently transduced primary CD4+T-lymphocytes and disrupted CCR5 expression, and the positively transduced cells were conferred with HIV-1 resistance.

One of skill in the art may utilize the above studies of, for example, Holt, N., et al. Nature biotechnology 28, 839-847 (2010), Li, L., et al. Molecular therapy: the journal of the American Society of Gene Therapy 21, 1259-1269 (2013), Mandal et al., Cell Stem Cell, Volume 15, Issue 5, p 643-652, 6 Nov. 2014, Wang et al. (PLoS One. 2014 Dec. 26; 9(12):e115987. doi: 10.1371/journal.pone.0115987), Fine et al. (Sci Rep. 2015 Jul. 1; 5:10777. doi: 10.1038/srep10777) and Li et al. (J Gen Virol. 2015 August; 96(8): 2381-93. doi: 10.1099/vir.0.000139. Epub 2015 Apr. 8) for targeting CCR5 with the CRISPR Cas system of the present invention.

Treating Pathogens, Like Viral Pathogens, Such as HBV

The present invention may also be applied to treat hepatitis B virus (HBV). However, the system must be adapted to avoid the shortcomings of RNAi, such as the risk of oversatring endogenous small RNA pathways, by for example, optimizing dose and sequence (see, e.g., Grimm et al., Nature vol. 441, 26 May 2006). For example, low doses, such as about $1-10\times10^{14}$ particles per human are contemplated. In another embodiment, the system directed against HBV may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of CRISPR Cas targeted to HBV RNA in a SNALP are contemplated. The daily treatment may be over about three days and then weekly for about five weeks. In another embodiment, the system of Chen et al. (Gene Therapy (2007) 14, 11-19) may be used/and or adapted for the system of the present invention. Chen et al. use a double-stranded adenoassociated virus 8-pseudotyped vector (dsAAV2/8) to deliver shRNA. A single administration of dsAAV2/8 vector ($1\times10^{12}$ vector genomes per mouse), carrying HBV-specific shRNA, effectively suppressed the steady level of HBV protein, mRNA and replicative DNA in liver of HBV transgenic mice, leading to up to 2-3 $\log^{10}$ decrease in HBV load in the circulation. Significant HBV suppression sustained for at least 120 days after vector administration. The therapeutic effect of shRNA was target sequence dependent and did not involve activation of interferon. For the present invention, a system directed to HBV may be cloned into an AAV vector, such as a dsAAV2/8 vector and administered to a human, for example, at a dosage of about $1\times10^{15}$ vector genomes to about $1\times10^{16}$ vector genomes per human. In another embodiment, the method of Wooddell et al. (Molecular Therapy vol. 21 no. 5, 973-985 May 2013) may be used/and or adapted to the system of the present invention. Woodell et al. show that simple coinjection of a hepatocyte-targeted, N-acetylgalactosamine-conjugated melittin-like peptide (NAG-MLP) with a liver-tropic cholesterol-conjugated siRNA (chol-siRNA) targeting coagulation factor VII (F7) results in efficient F7 knockdown in mice and nonhuman primates without changes in clinical chemistry or induction of cytokines. Using transient and transgenic mouse models of HBV infection, Wooddell et al. show that a single coinjection of NAG-MLP with potent chol-siRNAs targeting conserved HBV sequences resulted in multilog repression of viral RNA, proteins, and viral DNA with long duration of effect. Intraveinous coinjections, for example, of about 6 mg/kg of NAG-MLP and 6 mg/kg of HBV specific CRISPR Cas may be envisioned for the present invention. In the alternative, about 3 mg/kg of NAG-MLP and 3 mg/kg of HBV specific CRISPR Cas may be delivered on day one, followed by administration of about about 2-3 mg/kg of NAG-MLP and 2-3 mg/kg of HBV specific CRISPR Cas two weeks later.

In some embodiments, the target sequence is an HBV sequence. In some embodiments, the target sequences is comprised in an episomal viral nucleic acid molecule which is not integrated into the genome of the organism to thereby manipulate the episomal viral nucleic acid molecule. In some embodiments, the episomal nucleic acid molecule is a double-stranded DNA polynucleotide molecule or is a covalently closed circular DNA (cccDNA). In some embodiments, the CRISPR complex is capable of reducing the amount of episomal viral nucleic acid molecule in a cell of the organism compared to the amount of episomal viral nucleic acid molecule in a cell of the organism in the absence of providing the complex, or is capable of manipulating the episomal viral nucleic acid molecule to promote degradation of the episomal nucleic acid molecule. In some embodiments, the target HBV sequence is integrated into the genome of the organism. In some embodiments, when formed within the cell, the CRISPR complex is capable of manipulating the integrated nucleic acid to promote excision of all or part of the target HBV nucleic acid from the genome of the organism. In some embodiments, said at least one target HBV nucleic acid is comprised in a double-stranded DNA polynucleotide cccDNA molecule and/or viral DNA integrated into the genome of the organism and wherein the CRISPR complex manipulates at least one target HBV nucleic acid to cleave viral cccDNA and/or integrated viral DNA. In some embodiments, said cleavage comprises one or more double-strand break(s) introduced into the viral cccDNA and/or integrated viral DNA, optionally at least two double-strand break(s). In some embodiments, said cleavage is via one or more single-strand break(s) introduced into the viral cccDNA and/or integrated viral DNA, optionally at least two single-strand break(s). In some embodiments, said one or more double-strand break(s) or said one or more single-strand break(s) leads to the formation of one or more insertion or deletion mutations (INDELs) in the viral cccDNA sequences and/or integrated viral DNA sequences.

Lin et al. (Mol Ther Nucleic Acids. 2014 Aug. 19; 3:e186. doi: 10.1038/mtna.2014.38) designed eight gRNAs against HBV of genotype A. With the HBV-specific gRNAs, the CRISPR-Cas9 system significantly reduced the production of HBV core and surface proteins in Huh-7 cells transfected with an HBV-expression vector. Among eight screened gRNAs, two effective ones were identified. One gRNA targeting the conserved HBV sequence acted against different genotypes. Using a hydrodynamics-HBV persistence mouse model, Lin et al. further demonstrated that this system could cleave the intrahepatic HBV genome-containing plasmid and facilitate its clearance in vivo, resulting in reduction of serum surface antigen levels. These data suggest that the CRISPR-Cas9 system could disrupt the HBV-expressing templates both in vitro and in vivo, indicating its potential in eradicating persistent HBV infection.

Dong et al. (Antiviral Res. 2015 June; 118:110-7. doi: 10.1016/j.antiviral.2015.03.015. Epub 2015 Apr. 3) used the CRISPR-Cas9 system to target the HBV genome and efficiently inhibit HBV infection. Dong et al. synthesized four single-guide RNAs (guide RNAs) targeting the conserved regions of HBV. The expression of these guide RNAS with Cas9 reduced the viral production in Huh7 cells as well as in HBV-replication cell HepG2.2.15. Dong et al. further demonstrated that CRISPR-Cas9 direct cleavage and cleavage-mediated mutagenesis occurred in HBV cccDNA of transfected cells. In the mouse model carrying HBV cccDNA, injection of guide RNA-Cas9 plasmids via rapid tail vein resulted in the low level of cccDNA and HBV protein.

Liu et al. (J Gen Virol. 2015 August; 96(8):2252-61. doi: 10.1099/vir.0.000159. Epub 2015 Apr. 22) designed eight guide RNAs (gRNAs) that targeted the conserved regions of different HBV genotypes, which could significantly inhibit HBV replication both in vitro and in vivo to investigate the possibility of using the CRISPR-Cas9 system to disrupt the HBV DNA templates. The HBV-specific gRNA/Type V effector system could inhibit the replication of HBV of different genotypes in cells, and the viral DNA was significantly reduced by a single gRNA/Type V effector system and cleared by a combination of different gRNA/Type V effector systems.

Wang et al. (World J Gastroenterol. 2015 Aug. 28; 21(32): 9554-65. doi: 10.3748/wjg.v21.i32.9554) designed 15 gRNAs against HBV of genotypes A-D. Eleven combinations of two above gRNAs (dual-gRNAs) covering the regulatory region of HBV were chosen. The efficiency of each gRNA and 11 dual-gRNAs on the suppression of HBV (genotypes A-D) replication was examined by the measurement of HBV surface antigen (HBsAg) or e antigen (HBeAg) in the culture supernatant. The destruction of HBV-expressing vector was examined in HuH7 cells co-transfected with dual-gRNAs and HBV-expressing vector using polymerase chain reaction (PCR) and sequencing method, and the destruction of cccDNA was examined in HepAD38 cells using KCl precipitation, plasmid-safe ATP-dependent DNase (PSAD) digestion, rolling circle amplification and quantitative PCR combined method. The cytotoxicity of these gRNAs was assessed by a mitochondrial tetrazolium assay. All of gRNAs could significantly reduce HBsAg or HBeAg production in the culture supernatant, which was dependent on the region in which gRNA against. All of dual gRNAs could efficiently suppress HBsAg and/or HBeAg production for HBV of genotypes A-D, and the efficacy of dual gRNAs in suppressing HBsAg and/or HBeAg production was significantly increased when compared to the single gRNA used alone. Furthermore, by PCR direct sequencing Applicant confirmed that these dual gRNAs could specifically destroy HBV expressing template by removing the fragment between the cleavage sites of the two used gRNAs. Most importantly, gRNA-5 and gRNA-12 combination not only could efficiently suppressing HBsAg and/or HBeAg production, but also destroy the cccDNA reservoirs in HepAD38 cells.

Karimova et al. (Sci Rep. 2015 Sep. 3; 5:13734. doi: 10.1038/srep13734) identified cross-genotype conserved HBV sequences in the S and X region of the HBV genome that were targeted for specific and effective cleavage by a Cas9 nickase. This approach disrupted not only episomal cccDNA and chromosomally integrated HBV target sites in reporter cell lines, but also HBV replication in chronically and de novo infected hepatoma cell lines.

One of skill in the art may utilize the above studies of, for example, Lin et al. (Mol Ther Nucleic Acids. 2014 Aug. 19; 3:e186. doi: 10.1038/mtna.2014.38), Dong et al. (Antiviral Res. 2015 June; 118:110-7. doi: 10.1016/j.antiviral.2015.03.015. Epub 2015 Apr. 3), Liu et al. (J Gen Virol. 2015 August; 96(8):2252-61. doi: 10.1099/vir.0.000159. Epub 2015 Apr. 22), Wang et al. (World J Gastroenterol. 2015 Aug. 28; 21(32):9554-65. doi: 10.3748/wjg.v21.i32.9554) and Karimova et al. (Sci Rep. 2015 Sep. 3; 5:13734. doi: 10.1038/srep13734) for targeting HBV with the CRISPR Cas system of the present invention.

Chronic hepatitis B virus (HBV) infection is prevalent, deadly, and seldom cured due to the persistence of viral episomal DNA (cccDNA) in infected cells. Ramanan et al. (Ramanan V, Shlomai A, Cox D B, Schwartz R E, Michailidis E, Bhatta A, Scott D A, Zhang F, Rice C M, Bhatia S N, Sci Rep. 2015 Jun. 2; 5:10833. doi: 10.1038/srep10833, published online 2 Jun. 2015) showed that the CRISPR/Cas9 system can specifically target and cleave conserved regions in the HBV genome, resulting in robust suppression of viral gene expression and replication. Upon sustained expression of Cas9 and appropriately chosen guide RNAs, they demonstrated cleavage of cccDNA by Cas9 and a dramatic reduction in both cccDNA and other parameters of viral gene expression and replication. Thus, they showed that directly targeting viral episomal DNA is a novel therapeutic approach to control the virus and possibly cure patients. This is also described in WO2015089465 A1, in the name of The Broad Institute et al., the contents of which are hereby incorporated by reference.

As such targeting viral episomal DNA in HBV is preferred in some embodiments.

The present invention may also be applied to treat pathogens, e.g. bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

The present invention may also be applied to treat hepatitis C virus (HCV). The methods of Roelvinki et al. (Molecular Therapy vol. 20 no. 9, 1737-1749 September 2012) may be applied to the CRISPR Cas system. For example, an AAV vector such as AAV8 may be a contemplated vector and for example a dosage of about $1.25\times10^{11}$ to $1.25\times10^{13}$ vector genomes per kilogram body weight (vg/kg) may be contemplated. The present invention may also be applied to treat pathogens, e.g. bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

Jiang et al. ("RNA-guided editing of bacterial genomes using CRISPR-Cas systems," Nature Biotechnology vol. 31, p. 233-9, March 2013) used a CRISPR-Cas9 system to mutate or kill S. pneumoniae and E. coli. The work, which introduced precise mutations into the genomes, relied on dual-RNA:Cas9-directed cleavage at the targeted genomic site to kill unmutated cells and circumvented the need for selectable markers or counter-selection systems. The systems have be used to reverse antibiotic resistance and eliminate the transfer of resistance between strains. Bickard et al. showed that Cas9, reprogrammed to target virulence genes, kills virulent, but not avirulent, S. aureus. Reprogramming the nuclease to target antibiotic resistance genes destroyed staphylococcal plasmids that harbor antibiotic resistance genes and immunized against the spread of plasmid-borne resistance genes. (see, Bikard et al., "Exploiting CRISPR-Cas nucleases to produce sequence-specific antimicrobials," Nature Biotechnology vol. 32, 1146-1150, doi: 10.1038/nbt.3043, published online 5 Oct. 2014.) Bikard showed that CRISPR-Cas9 antimicrobials function in vivo to kill S. aureus in a mouse skin colonization model. Similarly, Yosef et al used a CRISPR system to target genes encoding enzymes that confer resistance to β-lactam antibiotics (see Yousef et al., "Temperate and lytic bacteriophages programmed to sensitize and kill antibiotic-resistant bacteria," Proc. Natl. Acad. Sci. USA, vol. 112, p. 7267-7272, doi: 10.1073/pnas.1500107112 published online May 18, 2015).

The systems can be used to edit genomes of parasites that are resistant to other genetic approaches. For example, a CRISPR-Cas9 system was shown to introduce double-stranded breaks into the in the *Plasmodium yoelii* genome (see, Zhang et al., "Efficient Editing of Malaria Parasite Genome Using the CRISPR/Cas9 System," mBio. vol. 5, e01414-14, July-August 2014). Ghorbal et al. ("Genome editing in the human malaria parasite *Plasmodium falciparum* using the CRISPR-Cas9 system," Nature Biotechnology, vol. 32, p. 819-821, doi: 10.1038/nbt.2925, published online Jun. 1, 2014) modified the sequences of two genes, orcl and kelch13, which have putative roles in gene silencing and emerging resistance to artemisinin, respectively. Parasites that were altered at the appropriate sites were recovered with very high efficiency, despite there being no direct selection for the modification, indicating that neutral or even deleterious mutations can be generated using this system. CRISPR-Cas9 is also used to modify the genomes of other pathogenic parasites, including *Toxoplasma gondii* (see Shen et al., "Efficient gene disruption in diverse strains of *Toxoplasma gondii* using CRISPR/CAS9," mBio vol. 5:e01114-14, 2014; and Sidik et al., "Efficient Genome Engineering of *Toxoplasma gondii* Using CRISPR/Cas9," PLoS One vol. 9, e100450, doi: 10.1371/journal.pone.0100450, published online Jun. 27, 2014).

Vyas et al. ("A *Candida albicans* CRISPR system permits genetic engineering of essential genes and gene families," Science Advances, vol. 1, e1500248, DOI: 10.1126/sciadv.1500248, Apr. 3, 2015) employed a CRISPR system to overcome long-standing obstacles to genetic engineering in *C. albicans* and efficiently mutate in a single experiment both copies of several different genes. In an organism where several mechanisms contribute to drug resistance, Vyas produced homozygous double mutants that no longer displayed the hyper-resistance to fluconazole or cycloheximide displayed by the parental clinical isolate Can90. Vyas also obtained homozygous loss-of-function mutations in essential genes of *C. albicans* by creating conditional alleles. Null alleles of DCR1, which is required for ribosomal RNA processing, are lethal at low temperature but viable at high temperature. Vyas used a repair template that introduced a nonsense mutation and isolated dcr1/dcr1 mutants that failed to grow at 16° C.

Treating Diseases with Genetic or Epigenetic Aspects

The systems of the present invention can be used to correct genetic mutations that were previously attempted with limited success using TALEN and ZFN and have been identified as potential targets for Cas9 systems, including as in published applications of Editas Medicine describing methods to use Cas9 systems to target loci to therapeutically address diseases with gene therapy, including, WO 2015/048577 CRISPR-RELATED METHODS AND COMPOSITIONS of Gluckmann et al.; WO 2015/070083 CRISPR-RELATED METHODS AND COMPOSITIONS WITH GOVERNING gRNAS of Glucksmann et al. In some embodiments, the treatment, prophylaxis or diagnosis of Primary Open Angle Glaucoma (POAG) is provided. The target is preferably the MYOC gene. This is described in WO2015153780, the disclosure of which is hereby incorporated by reference.

Mention is made of WO2015/134812 CRISPR/CAS-RELATED METHODS AND COMPOSITIONS FOR TREATING USHER SYNDROME AND RETINITIS PIGMENTOSA of Maeder et al. Through the teachings herein the invention comprehends methods and materials of these documents applied in conjunction with the teachings herein. In an aspect of ocular and auditory gene therapy, methods and compositions for treating Usher Syndrome and Retinis-Pigmentosa may be adapted to the system of the present invention (see, e.g., WO 2015/134812). In an embodiment, the WO 2015/134812 involves a treatment or delaying the onset or progression of Usher Syndrome type IIA (USH2A, USH11A) and retinitis pigmentosa 39 (RP39) by gene editing, e.g., using CRISPR-Cas9 mediated methods to correct the guanine deletion at position 2299 in the USH2A gene (e.g., replace the deleted guanine residue at position 2299 in the USH2A gene). A similar effect can be achieved with a Type V effector. In a related aspect, a mutation is targeted by cleaving with either one or more nuclease, one or more nickase, or a combination thereof, e.g., to induce HDR with a donor template that corrects the point mutation (e.g., the single nucleotide, e.g., guanine, deletion). The alteration or correction of the mutant USH2A gene can be mediated by any mechanism. Exemplary mechanisms that can be associated with the alteration (e.g., correction) of the mutant HSH2A gene include, but are not limited to, non-homologous end joining, microhomology-mediated end joining (MMEJ), homology-directed repair (e.g., endogenous donor template mediated), SDSA (synthesis dependent strand annealing), single-strand annealing or single strand invasion. In an embodiment, the method used for treating Usher Syndrome and Retinis-Pigmentosa can include acquiring knowledge of the mutation carried by the subject, e.g., by sequencing the appropriate portion of the USH2A gene.

Accordingly, in some embodiments, the treatment, prophylaxis or diagnosis of Retinitis Pigmentosa is provided. A number of different genes are known to be associated with or result in Retinitis Pigmentosa, such as RP1, RP2 and so forth. These genes are targeted in some embodiments and either knocked out or repaired through provision of suitable a template. In some embodiments, delivery is to the eye by injection.

One or more Retinitis Pigmentosa genes can, in some embodiments, be selected from: RP1 (Retinitis pigmentosa-1), RP2 (Retinitis pigmentosa-2), RPGR (Retinitis pigmentosa-3), PRPH2 (Retinitis pigmentosa-7), RP9 (Retinitis pigmentosa-9), IMPDH1 (Retinitis pigmentosa-10), PRPF31 (Retinitis pigmentosa-11), CRB1 (Retinitis pigmentosa-12, autosomal recessive), PRPF8 (Retinitis pigmentosa-13), TULP1 (Retinitis pigmentosa-14), CA4 (Retinitis pigmentosa-17), HPRPF3 (Retinitis pigmentosa-18), ABCA4 (Retinitis pigmentosa-19), EYS (Retinitis pigmentosa-25), CERKL (Retinitis pigmentosa-26), FSCN2 (Retinitis pigmentosa-30), TOPORS (Retinitis pigmentosa-31), SNRNP200 (Retinitis pigmentosa 33), SEMA4A (Retinitis pigmentosa-35), PRCD (Retinitis pigmentosa-36), NR2E3 (Retinitis pigmentosa-37), MERTK (Retinitis pigmentosa-38), USH2A (Retinitis pigmentosa-39), PROM1 (Retinitis pigmentosa-41), KLHL7 (Retinitis pigmentosa-42), CNGB1 (Retinitis pigmentosa-45), BEST1 (Retinitis pigmentosa-50), TTC8 (Retinitis pigmentosa 51), C2orf71 (Retinitis pigmentosa 54), ARL6 (Retinitis pigmentosa 55), ZNF513 (Retinitis pigmentosa 58), DHDDS (Retinitis pigmentosa 59), BEST1 (Retinitis pigmentosa, concentric), PRPH2 (Retinitis pigmentosa, digenic), LRAT (Retinitis pigmentosa, juvenile), SPATA7 (Retinitis pigmentosa, juvenile, autosomal recessive), CRX (Retinitis pigmentosa, late-onset dominant), and/or RPGR (Retinitis pigmentosa, X-linked, and sinorespiratory infections, with or without deafness).

In some embodiments, the Retinitis Pigmentosa gene is MERTK (Retinitis pigmentosa-38) or USH2A (Retinitis pigmentosa-39).

Mention is also made of WO 2015/138510 and through the teachings herein the invention (using a CRISPR-Cas9 system) comprehends providing a treatment or delaying the onset or progression of Leber's Congenital Amaurosis 10 (LCA 10). LCA 10 is caused by a mutation in the CEP290 gene, e.g., a c.2991+1655, adenine to guanine mutation in the CEP290 gene which gives rise to a cryptic splice site in intron 26. This is a mutation at nucleotide 1655 of intron 26 of CEP290, e.g., an A to G mutation. CEP290 is also known as: CT87; MKS4; POC3; rd16; BBS14; JBTSS; LCAJO; NPHP6; SLSN6; and 3H11Ag (see, e.g., WO 2015/138510). In an aspect of gene therapy, the invention involves introducing one or more breaks near the site of the LCA target position (e.g., c.2991+1655; A to G) in at least one allele of the CEP290 gene. Altering the LCA10 target position refers to (1) break-induced introduction of an indel (also referred to herein as NHEJ-mediated introduction of an indel) in close proximity to or including a LCA10 target position (e.g., c.2991+1655A to G), or (2) break-induced deletion (also referred to herein as NHEJ-mediated deletion) of genomic sequence including the mutation at a LCA10 target position (e.g., c.2991+1655A to G). Both approaches give rise to the loss or destruction of the cryptic splice site resulting from the mutation at the LCA 10 target position. Accordingly, the use of a Type V CRISPR system in the treatment of LCA is specifically envisaged.

Researchers are contemplating whether gene therapies could be employed to treat a wide range of diseases. The systems of the present invention based on Type V effector protein are envisioned for such therapeutic uses, including, but noted limited to further exemplified targeted areas and with delivery methods as below. Some examples of conditions or diseases that might be usefully treated using the present system are included in the examples of genes and references included herein and are currently associated with those conditions are also provided there. The genes and conditions exemplified are not exhaustive. Treating Diseases of the Circulatory System The present invention also contemplates delivering the system, specifically the novel CRISPR effector protein systems described herein, to the blood or hematopoietic stem cells. The plasma exosomes of Wahlgren et al. (Nucleic Acids Research, 2012, Vol. 40, No. 17 e130) were previously described and may be utilized to deliver the system to the blood. The nucleic acid-targeting system of the present invention is also contemplated to treat hemoglobinopathies, such as thalassemias and sickle cell disease. See, e.g., International Patent Publication No. WO 2013/126794 for potential targets that may be targeted by the CRISPR Cas system of the present invention.

Drakopoulou, "Review Article, The Ongoing Challenge of Hematopoietic Stem Cell-Based Gene Therapy for β-Thalassemia," Stem Cells International, Volume 2011, Article ID 987980, 10 pages, doi:10.4061/2011/987980, incorporated herein by reference along with the documents it cites, as if set out in full, discuss modifying HSCs using a lentivirus that delivers a gene for β-globin or γ-globin. In contrast to using lentivirus, with the knowledge in the art and the teachings in this disclosure, the skilled person can correct HSCs as to β-Thalassemia using a system that targets and corrects the mutation (e.g., with a suitable HDR template that delivers a coding sequence for β-globin or γ-globin, advantageously non-sickling β-globin or γ-globin); specifically, the guide RNA can target mutation that give rise to β-Thalassemia, and the HDR can provide coding for proper expression of β-globin or γ-globin. An guide RNA that targets the mutation-and-Cas protein containing particle is contacted with HSCs carrying the mutation. The particle also can contain a suitable HDR template to correct the mutation for proper expression of β-globin or γ-globin; or the HSC can be contacted with a second particle or a vector that contains or delivers the HDR template. The so contacted cells can be administered; and optionally treated/expanded; cf. Cartier. In this regard mention is made of: Cavazzana, "Outcomes of Gene Therapy for 13-Thalassemia Major via Transplantation of Autologous Hematopoietic Stem Cells Transduced Ex Vivo with a Lentiviral βA-T87Q-Globin Vector." tif2014.org/abstractFilesaean%20-Antoine %20Ribeil_Abstract.pdf; Cavazzana-Calvo, "Transfusion independence and HMGA2 activation after gene therapy of human β-thalassaemia", Nature 467, 318-322 (16 Sep. 2010) doi:10.1038/nature09328; Nienhuis, "Development of Gene Therapy for Thalassemia, Cold Spring Harbor Perpsectives in Medicine, doi: 10.1101/cshperspect.a011833 (2012), LentiGlobin BB305, a lentivi ral vector containing an engineered β-globin gene (βA-T87Q); and Xie et al., "Seamless gene correction of β-thalassaemia mutations in patient-specific iPSCs using CRISPR/Cas9 and piggyback" Genome Research gr.173427.114 (2014) www.genome.org/cgi/doi/10.1101/gr.173427.114 (Cold Spring Harbor Laboratory Press); that is the subject of Cavazzana work involving human β-thalassaemia and the subject of the Xie work, are all incorporated herein by reference, together with all documents cited therein or associated therewith. In the instant invention, the HDR template can provide for the HSC to express an engineered β-globin gene (e.g., βA-T87Q), or β-globin as in Xie.

Xu et al. (Sci Rep. 2015 Jul. 9; 5:12065. doi: 10.1038/srep12065) have designed TALENs and CRISPR-Cas9 to directly target the intron2 mutation site IVS2-654 in the globin gene. Xu et al. observed different frequencies of double-strand breaks (DSBs) at IVS2-654 loci using TALENs and CRISPR-Cas9, and TALENs mediated a higher homologous gene targeting efficiency compared to CRISPR-Cas9 when combined with the piggyBac transposon donor. In addition, more obvious off-target events were observed for CRISPR-Cas9 compared to TALENs. Finally, TALENs-corrected iPSC clones were selected for erythroblast differentiation using the OP9 co-culture system and detected relatively higher transcription of HBB than the uncorrected cells.

Song et al. (Stem Cells Dev. 2015 May 1; 24(9):1053-65. doi: 10.1089/scd.2014.0347. Epub 2015 Feb. 5) used CRISPR/Cas9 to correct β-Thal iPSCs; gene-corrected cells exhibit normal karyotypes and full pluripotency as human embryonic stem cells (hESCs) showed no off-targeting effects. Then, Song et al. evaluated the differentiation efficiency of the gene-corrected β-Thal iPSCs. Song et al. found that during hematopoietic differentiation, gene-corrected β-Thal iPSCs showed an increased embryoid body ratio and various hematopoietic progenitor cell percentages. More importantly, the gene-corrected β-Thal iPSC lines restored HBB expression and reduced reactive oxygen species production compared with the uncorrected group. Song et al.'s study suggested that hematopoietic differentiation efficiency of β-Thal iPSCs was greatly improved once corrected by the CRISPR-Cas9 system. Similar methods may be performed utilizing the systems described herein, e.g. systems comprising Type V effector proteins.

Sickle cell anemia is an autosomal recessive genetic disease in which red blood cells become sickle-shaped. It is caused by a single base substitution in the β-globin gene, which is located on the short arm of chromosome 11. As a result, valine is produced instead of glutamic acid causing the production of sickle hemoglobin (HbS). This results in the formation of a distorted shape of the erythrocytes. Due to this abnormal shape, small blood vessels can be blocked, causing serious damage to the bone, spleen and skin tissues. This may lead to episodes of pain, frequent infections, hand-foot syndrome or even multiple organ failure. The distorted erythrocytes are also more susceptible to hemolysis, which leads to serious anemia. As in the case of β-thalassaemia, sickle cell anemia can be corrected by modifying HSCs with the system. The system allows the specific editing of the cell's genome by cutting its DNA and then letting it repair itself. The Cas protein is inserted and directed by a RNA guide to the mutated point and then it cuts the DNA at that point. Simultaneously, a healthy version of the sequence is inserted. This sequence is used by the cell's own repair system to fix the induced cut. In this way, the CRISPR-Cas allows the correction of the mutation in the previously obtained stem cells. With the knowledge in the art and the teachings in this disclosure, the skilled person can correct HSCs as to sickle cell anemia using a system that targets and corrects the mutation (e.g., with a suitable HDR template that delivers a coding sequence for β-globin, advantageously non-sickling β-globin); specifically, the guide RNA can target mutation that give rise to sickle cell anemia, and the HDR can provide coding for proper expression of β-globin. An guide RNA that targets the mutation-and-Cas protein containing particle is contacted with HSCs carrying the mutation. The particle also can contain a suitable HDR template to correct the mutation for proper expression of β-globin; or the HSC can be contacted with a second particle or a vector that contains or delivers the HDR template. The so contacted cells can be administered; and optionally treated/expanded; cf. Cartier. The HDR template can provide for the HSC to express an engineered β-globin gene (e.g., βA-T87Q), or β-globin as in Xie.

Williams, "Broadening the Indications for Hematopoietic Stem Cell Genetic Therapies," Cell Stem Cell 13:263-264 (2013), incorporated herein by reference along with the documents it cites, as if set out in full, report lentivirus-mediated gene transfer into HSC/P cells from patients with the lysosomal storage disease metachromatic leukodystrophy disease (MLD), a genetic disease caused by deficiency of arylsulfatase A (ARSA), resulting in nerve demyelination; and lentivirus-mediated gene transfer into HSCs of patients with Wiskott-Aldrich syndrome (WAS) (patients with defective WAS protein, an effector of the small GTPase CDC142 that regulates cytoskeletal function in blood cell lineages and thus suffer from immune deficiency with recurrent infections, autoimmune symptoms, and thrombocytopenia with abnormally small and dysfunctional platelets leading to excessive bleeding and an increased risk of leukemia and lymphoma). In contrast to using lentivirus, with the knowledge in the art and the teachings in this disclosure, the skilled person can correct HSCs as to MLD (deficiency of arylsulfatase A (ARSA)) using a system that targets and corrects the mutation (deficiency of arylsulfatase A (ARSA)) (e.g., with a suitable HDR template that delivers a coding sequence for ARSA); specifically, the guide RNA can target mutation that gives rise to MLD (deficient ARSA), and the HDR can provide coding for proper expression of ARSA. An guide RNA that targets the mutation-and-Cas protein containing particle is contacted with HSCs carrying the mutation. The particle also can contain a suitable HDR template to correct the mutation for proper expression of ARSA; or the HSC can be contacted with a second particle or a vector that contains or delivers the HDR template. The so contacted cells can be administered; and optionally treated/expanded; cf. Cartier. In contrast to using lentivirus, with the knowledge in the art and the teachings in this disclosure, the skilled person can correct HSCs as to WAS using a system that targets and corrects the mutation (deficiency of WAS protein) (e.g., with a suitable HDR template that delivers a coding sequence for WAS protein); specifically, the guide RNA can target mutation that gives rise to WAS (deficient WAS protein), and the HDR can provide coding for proper expression of WAS protein. An guide RNA that targets the mutation-and-Type V protein containing particle is contacted with HSCs carrying the mutation. The particle also can contain a suitable HDR template to correct the mutation for proper expression of WAS protein; or the HSC can be contacted with a second particle or a vector that contains or delivers the HDR template. The so contacted cells can be administered; and optionally treated/expanded; cf. Cartier.

Watts, "Hematopoietic Stem Cell Expansion and Gene Therapy" Cytotherapy 13(10):1164-1171. doi:10.3109/

14653249.2011.620748 (2011), incorporated herein by reference along with the documents it cites, as if set out in full, discusses hematopoietic stem cell (HSC) gene therapy, e.g., virus-mediated HSC gene therapy, as an highly attractive treatment option for many disorders including hematologic conditions, immunodeficiencies including HIV/AIDS, and other genetic disorders like lysosomal storage diseases, including SCID-X1, ADA-SCID, β-thalassemia, X-linked CGD, Wiskott-Aldrich syndrome, Fanconi anemia, adrenoleukodystrophy (ALD), and metachromatic leukodystrophy (MLD).

US Patent Publication Nos. 20110225664, 20110091441, 20100229252, 20090271881 and 20090222937 assigned to Cellectis, relates to CREI variants, wherein at least one of the two I-CreI monomers has at least two substitutions, one in each of the two functional subdomains of the LAGLIDADG (SEQ ID NO:929) core domain situated respectively from positions 26 to 40 and 44 to 77 of I-CreI, said variant being able to cleave a DNA target sequence from the human interleukin-2 receptor gamma chain (IL2RG) gene also named common cytokine receptor gamma chain gene or gamma C gene. The target sequences identified in US Patent Publication Nos. 20110225664, 20110091441, 20100229252, 20090271881 and 20090222937 may be utilized for the nucleic acid-targeting system of the present invention.

Severe Combined Immune Deficiency (SCID) results from a defect in lymphocytes T maturation, always associated with a functional defect in lymphocytes B (Cavazzana-Calvo et al., Annu. Rev. Med., 2005, 56, 585-602; Fischer et al., Immunol. Rev., 2005, 203, 98-109). Overall incidence is estimated to 1 in 75 000 births. Patients with untreated SCID are subject to multiple opportunist micro-organism infections, and do generally not live beyond one year. SCID can be treated by allogenic hematopoietic stem cell transfer, from a familial donor. Histocompatibility with the donor can vary widely. In the case of Adenosine Deaminase (ADA) deficiency, one of the SCID forms, patients can be treated by injection of recombinant Adenosine Deaminase enzyme.

Since the ADA gene has been shown to be mutated in SCID patients (Giblett et al., Lancet, 1972, 2, 1067-1069), several other genes involved in SCID have been identified (Cavazzana-Calvo et al., Annu. Rev. Med., 2005, 56, 585-602; Fischer et al., Immunol. Rev., 2005, 203, 98-109). There are four major causes for SCID: (i) the most frequent form of SCID, SCID-X1 (X-linked SCID or X-SCID), is caused by mutation in the IL2RG gene, resulting in the absence of mature T lymphocytes and NK cells. IL2RG encodes the gamma C protein (Noguchi, et al., Cell, 1993, 73, 147-157), a common component of at least five interleukin receptor complexes. These receptors activate several targets through the JAK3 kinase (Macchi et al., Nature, 1995, 377, 65-68), which inactivation results in the same syndrome as gamma C inactivation; (ii) mutation in the ADA gene results in a defect in purine metabolism that is lethal for lymphocyte precursors, which in turn results in the quasi absence of B, T and NK cells; (iii) V(D)J recombination is an essential step in the maturation of immunoglobulins and T lymphocytes receptors (TCRs). Mutations in Recombination Activating Gene 1 and 2 (RAG1 and RAG2) and Artemis, three genes involved in this process, result in the absence of mature T and B lymphocytes; and (iv) Mutations in other genes such as CD45, involved in T cell specific signaling have also been reported, although they represent a minority of cases (Cavazzana-Calvo et al., Annu. Rev. Med., 2005, 56, 585-602; Fischer et al., Immunol. Rev., 2005, 203, 98-109). Since when their genetic bases have been identified, the different SCID forms have become a paradigm for gene therapy approaches (Fischer et al., Immunol. Rev., 2005, 203, 98-109) for two major reasons. First, as in all blood diseases, an ex vivo treatment can be envisioned. Hematopoietic Stem Cells (HSCs) can be recovered from bone marrow, and keep their pluripotent properties for a few cell divisions. Therefore, they can be treated in vitro, and then reinjected into the patient, where they repopulate the bone marrow. Second, since the maturation of lymphocytes is impaired in SCID patients, corrected cells have a selective advantage. Therefore, a small number of corrected cells can restore a functional immune system. This hypothesis was validated several times by (i) the partial restoration of immune functions associated with the reversion of mutations in SCID patients (Hirschhorn et al., Nat. Genet., 1996, 13, 290-295; Stephan et al., N. Engl. J. Med., 1996, 335, 1563-1567; Bousso et al., Proc. Natl., Acad. Sci. USA, 2000, 97, 274-278; Wada et al., Proc. Natl. Acad. Sci. USA, 2001, 98, 8697-8702; Nishikomori et al., Blood, 2004, 103, 4565-4572), (ii) the correction of SCID-X1 deficiencies in vitro in hematopoietic cells (Candotti et al., Blood, 1996, 87, 3097-3102; Cavazzana-Calvo et al., Blood, 1996, Blood, 88, 3901-3909; Taylor et al., Blood, 1996, 87, 3103-3107; Hacein-Bey et al., Blood, 1998, 92, 4090-4097), (iii) the correction of SCID-X1 (Soudais et al., Blood, 2000, 95, 3071-3077; Tsai et al., Blood, 2002, 100, 72-79), JAK-3 (Bunting et al., Nat. Med., 1998, 4, 58-64; Bunting et al., Hum. Gene Ther., 2000, 11, 2353-2364) and RAG2 (Yates et al., Blood, 2002, 100, 3942-3949) deficiencies in vivo in animal models and (iv) by the result of gene therapy clinical trials (Cavazzana-Calvo et al., Science, 2000, 288, 669-672; Aiuti et al., Nat. Med., 2002; 8, 423-425; Gaspar et al., Lancet, 2004, 364, 2181-2187).

US Patent Publication No. 20110182867 assigned to the Children's Medical Center Corporation and the President and Fellows of Harvard College relates to methods and uses of modulating fetal hemoglobin expression (HbF) in a hematopoietic progenitor cells via inhibitors of BCL11A expression or activity, such as RNAi and antibodies. The targets disclosed in US Patent Publication No. 20110182867, such as BCL11A, may be targeted by the CRISPR Cas system of the present invention for modulating fetal hemoglobin expression. See also Bauer et al. (Science 11 Oct. 2013: Vol. 342 no. 6155 pp. 253-257) and Xu et al. (Science 18 Nov. 2011: Vol. 334 no. 6058 pp. 993-996) for additional BCL11A targets.

With the knowledge in the art and the teachings in this disclosure, the skilled person can correct HSCs as to a genetic hematologic disorder, e.g., β-Thalassemia, Hemophilia, or a genetic lysosomal storage disease.

HSC-Delivery to and Editing of Hematopoietic Stem Cells; and Particular Conditions.

The term "Hematopoietic Stem Cell" or "HSC" is meant to include broadly those cells considered to be an HSC, e.g., blood cells that give rise to all the other blood cells and are derived from mesoderm; located in the red bone marrow, which is contained in the core of most bones. HSCs of the invention include cells having a phenotype of hematopoietic stem cells, identified by small size, lack of lineage (lin) markers, and markers that belong to the cluster of differentiation series, like: CD34, CD38, CD90, CD133, CD105, CD45, and also c-kit, —the receptor for stem cell factor. Hematopoietic stem cells are negative for the markers that are used for detection of lineage commitment, and are, thus, called Lin−; and, during their purification by FACS, a number of up to 14 different mature blood-lineage markers, e.g., CD13 & CD33 for myeloid, CD71 for erythroid, CD19 for B cells, CD61 for megakaryocytic, etc. for humans; and, B220 (murine CD45) for B cells, Mac-1 (CD11b/CD18) for monocytes, Gr-1 for Granulocytes, Ter119 for erythroid cells, Il7Ra, CD3, CD4, CD5, CD8 for T cells, etc. Mouse HSC markers: CD34lo/−, SCA-1+, Thy1.1+/lo, CD38+, C-kit+, lin−, and Human HSC markers: CD34+, CD59+, Thy1/CD90+, CD38lo/−, C-kit/CD117+, and lin−. HSCs are identified by markers. Hence in embodiments discussed herein, the HSCs can be CD34+ cells. HSCs can also be hematopoietic stem cells that are CD34−/CD38−. Stem cells that may lack c-kit on the cell surface that are considered in the art as HSCs are within the ambit of the invention, as well as CD133+ cells likewise considered HSCs in the art.

The system may be engineered to target genetic locus or loci in HSCs. Cas protein, advantageously codon-optimized for a eukaryotic cell and especially a mammalian cell, e.g., a human cell, for instance, HSC, and sgRNA targeting a locus or loci in HSC, e.g., the gene EMX1, may be prepared. These may be delivered via particles. The particles may be formed by the Cas protein and the gRNA being admixed. The gRNA and Cas protein mixture may for example be admixed with a mixture comprising or consisting essentially of or consisting of surfactant, phospholipid, biodegradable polymer, lipoprotein and alcohol, whereby particles containing the gRNA and Cas protein may be formed. The invention comprehends so making particles and particles from such a method as well as uses thereof.

More generally, particles may be formed using an efficient process. First, Cas Type V effector protein and gRNA targeting the gene EMX1 or the control gene LacZ may be mixed together at a suitable, e.g., 3:1 to 1:3 or 2:1 to 1:2 or 1:1 molar ratio, at a suitable temperature, e.g., 15-30° C., e.g., 20-25° C., e.g., room temperature, for a suitable time, e.g., 15-45, such as 30 minutes, advantageously in sterile, nuclease free buffer, e.g., 1X PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol may be dissolved in an alcohol, advantageously a C1-6 alkyl alcohol, such as methanol, ethanol, isopropanol, e.g., 100% ethanol. The two solutions may be mixed together to form particles containing the Cas Type V effector-gRNA complexes. In certain embodiments the particle can contain an HDR template. That can be a particle co-administered with gRNA+Cas protein-containing particle, or i.e., in addition to contacting an HSC with an gRNA+Cas protein-containing particle, the HSC is contacted with a particle containing an HDR template; or the HSC is contacted with a particle containing all of the gRNA, Cas and the HDR template. The HDR template can be administered by a separate vector, whereby in a first instance the particle penetrates an HSC cell and the separate vector also penetrates the cell, wherein the HSC genome is modified by the gRNA+Cas and the HDR template is also present, whereby a genomic loci is modified by the HDR; for instance, this may result in correcting a mutation.

After the particles form, HSCs in 96 well plates may be transfected with 15 ug Type V effector protein per well. Three days after transfection, HSCs may be harvested, and the number of insertions and deletions (indels) at the EMX1 locus may be quantified.

This illustrates how HSCs can be modified using the systems targeting a genomic locus or loci of interest in the HSC. The HSCs that are to be modified can be in vivo, i.e., in an organism, for example a human or a non-human eukaryote, e.g., animal, such as fish, e.g., zebra fish, mammal, e.g., primate, e.g., ape, chimpanzee, macaque, rodent, e.g., mouse, rabbit, rat, canine or dog, livestock (cow/bovine, sheep/ovine, goat or pig), fowl or poultry, e.g., chicken. The HSCs that are to be modified can be in vitro, i.e., outside of such an organism. And, modified HSCs can be used ex vivo, i.e., one or more HSCs of such an organism can be obtained or isolated from the organism, optionally the HSC(s) can be expanded, the HSC(s) are modified by a composition comprising a CRISPR-Cas that targets a genetic locus or loci in the HSC, e.g., by contacting the HSC(s) with the composition, for instance, wherein the composition comprises a particle containing the CRISPR enzyme and one or more gRNA that targets the genetic locus or loci in the HSC, such as a particle obtained or obtainable from admixing an gRNA and Cas protein mixture with a mixture comprising or consisting essentially of or consisting of surfactant, phospholipid, biodegradable polymer, lipoprotein and alcohol (wherein one or more gRNA targets the genetic locus or loci in the HSC), optionally expanding the resultant modified HSCs and administering to the organism the resultant modified HSCs. In some instances the isolated or obtained HSCs can be from a first organism, such as an organism from a same species as a second organism, and the second organism can be the organism to which the resultant modified HSCs are administered, e.g., the first organism can be a donor (such as a relative as in a parent or sibling) to the second organism. Modified HSCs can have genetic modifications to address or alleviate or reduce symptoms of a disease or condition state of an individual or subject or patient. Modified HSCs, e.g., in the instance of a first organism donor to a second organism, can have genetic modifications to have the HSCs have one or more proteins e.g. surface markers or proteins more like that of the second organism. Modified HSCs can have genetic modifications to simulate a disease or condition state of an individual or subject or patient and would be re-administered to a non-human organism so as to prepare an animal model. Expansion of HSCs is within the ambit of the skilled person from this disclosure and knowledge in the art, see e.g., Lee, "Improved ex vivo expansion of adult hematopoietic stem cells by overcoming CUL4-mediated degradation of HOXB4." Blood. 2013 May 16; 121(20):4082-9. doi: 10.1182/blood-2012-09-455204. Epub 2013 Mar. 21.

As indicated to improve activity, gRNA may be pre-complexed with the Cas protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. The invention accordingly comprehends admixing gRNA, Cas protein and components that form a particle; as well as particles from such admixing.

In a preferred embodiment, particles containing the Cas-gRNA complexes may be formed by mixing Cas protein and one or more gRNAs together, preferably at a 1:1 molar ratio, enzyme:guide RNA. Separately, the different components known to promote delivery of nucleic acids (e.g. DOTAP, DMPC, PEG, and cholesterol) are dissolved, preferably in ethanol. The two solutions are mixed together to form particles containing the Cas-gRNA complexes. After the particles are formed, Cas-gRNA complexes may be transfected into cells (e.g. HSCs). Bar coding may be applied. The particles, the Cas-9 and/or the gRNA may be barcoded.

The invention in an embodiment comprehends a method of preparing an gRNA-and-Cas protein containing particle comprising admixing an gRNA and Cas protein mixture with a mixture comprising or consisting essentially of or consisting of surfactant, phospholipid, biodegradable polymer, lipoprotein and alcohol. An embodiment comprehends an gRNA-and-Cas protein containing particle from the method. The invention in an embodiment comprehends use of the particle in a method of modifying a genomic locus of interest, or an organism or a non-human organism by manipulation of a target sequence in a genomic locus of interest, comprising contacting a cell containing the genomic locus of interest with the particle wherein the gRNA targets the genomic locus of interest; or a method of modifying a genomic locus of interest, or an organism or a non-human organism by manipulation of a target sequence in a genomic locus of interest, comprising contacting a cell containing the genomic locus of interest with the particle wherein the gRNA targets the genomic locus of interest. In these embodiments, the genomic locus of interest is advantageously a genomic locus in an HSC.

Considerations for Therapeutic Applications: A consideration in genome editing therapy is the choice of sequence-specific nuclease, such as a variant of a Type V nuclease. Each nuclease variant may possess its own unique set of strengths and weaknesses, many of which must be balanced in the context of treatment to maximize therapeutic benefit. Thus far, two therapeutic editing approaches with nucleases have shown significant promise: gene disruption and gene correction. Gene disruption involves stimulation of NHEJ to create targeted indels in genetic elements, often resulting in loss of function mutations that are beneficial to patients. In contrast, gene correction uses HDR to directly reverse a disease causing mutation, restoring function while preserving physiological regulation of the corrected element. HDR may also be used to insert a therapeutic transgene into a defined 'safe harbor' locus in the genome to recover missing gene function. For a specific editing therapy to be efficacious, a sufficiently high level of modification must be achieved in target cell populations to reverse disease symptoms. This therapeutic modification 'threshold' is determined by the fitness of edited cells following treatment and the amount of gene product necessary to reverse symptoms. With regard to fitness, editing creates three potential outcomes for treated cells relative to their unedited counterparts: increased, neutral, or decreased fitness. In the case of increased fitness, for example in the treatment of SCID-X1, modified hematopoietic progenitor cells selectively expand relative to their unedited counterparts. SCID-X1 is a disease caused by mutations in the IL2RG gene, the function of which is required for proper development of the hematopoietic lymphocyte lineage [Leonard, W. J., et al. Immunological reviews 138, 61-86 (1994); Kaushansky, K. & Williams, W. J. Williams hematology, (McGraw-Hill Medical, New York, 2010)]. In clinical trials with patients who received viral gene therapy for SCID-X1, and a rare example of a spontaneous correction of SCID-X1 mutation, corrected hematopoietic progenitor cells may be able to overcome this developmental block and expand relative to their diseased counterparts to mediate therapy [Bousso, P., et al. Proceedings of the National Academy of Sciences of the United States of America 97, 274-278 (2000); Hacein-Bey-Abina, S., et al. The New England journal of medicine 346, 1185-1193 (2002); Gaspar, H. B., et al. Lancet 364, 2181-2187 (2004)]. In this case, where edited cells possess a selective advantage, even low numbers of edited cells can be amplified through expansion, providing a therapeutic benefit to the patient. In contrast, editing for other hematopoietic diseases, like chronic granulomatous disorder (CGD), would induce no change in fitness for edited hematopoietic progenitor cells, increasing the therapeutic modification threshold. CGD is caused by mutations in genes encoding phagocytic oxidase proteins, which are normally used by neutrophils to generate reactive oxygen species that kill pathogens [Mukherjee, S. & Thrasher, A. J. Gene 525, 174-181 (2013)]. As dysfunction of these genes does not influence hematopoietic progenitor cell fitness or development, but only the ability of a mature hematopoietic cell type to fight infections, there would be likely no preferential expansion of edited cells in this disease. Indeed, no selective advantage for gene corrected cells in CGD has been observed in gene therapy trials, leading to difficulties with long-term cell engraftment [Malech, H. L., et al. Proceedings of the National Academy of Sciences of the United States of America 94, 12133-12138 (1997); Kang, H. J., et al. Molecular therapy: the journal of the American Society of Gene Therapy 19, 2092-2101 (2011)]. As such, significantly higher levels of editing would be required to treat diseases like CGD, where editing creates a neutral fitness advantage, relative to diseases where editing creates increased fitness for target cells. If editing imposes a fitness disadvantage, as would be the case for restoring function to a tumor suppressor gene in cancer cells, modified cells would be outcompeted by their diseased counterparts, causing the benefit of treatment to be low relative to editing rates. This latter class of diseases would be particularly difficult to treat with genome editing therapy.

In addition to cell fitness, the amount of gene product necessary to treat disease also influences the minimal level of therapeutic genome editing that must be achieved to reverse symptoms. Haemophilia B is one disease where a small change in gene product levels can result in significant changes in clinical outcomes. This disease is caused by mutations in the gene encoding factor IX, a protein normally secreted by the liver into the blood, where it functions as a component of the clotting cascade. Clinical severity of haemophilia B is related to the amount of factor IX activity. Whereas severe disease is associated with less than 1% of normal activity, milder forms of the diseases are associated with greater than 1% of factor IX activity [Kaushansky, K. & Williams, W. J. Williams hematology, (McGraw-Hill Medical, New York, 2010); Lofqvist, T., et al. Journal of internal medicine 241, 395-400 (1997)]. This suggests that editing therapies that can restore factor IX expression to even a small percentage of liver cells could have a large impact on clinical outcomes. A study using ZFNs to correct a mouse model of haemophilia B shortly after birth demonstrated that 3-7% correction was sufficient to reverse disease symptoms, providing preclinical evidence for this hypothesis [Li, H., et al. Nature 475, 217-221 (2011)].

Disorders where a small change in gene product levels can influence clinical outcomes and diseases where there is a fitness advantage for edited cells, are ideal targets for genome editing therapy, as the therapeutic modification threshold is low enough to permit a high chance of success given the current technology. Targeting these diseases has now resulted in successes with editing therapy at the pre-clinical level and a phase I clinical trial. Improvements in DSB repair pathway manipulation and nuclease delivery are needed to extend these promising results to diseases with a neutral fitness advantage for edited cells, or where larger amounts of gene product are needed for treatment. Table 6 below shows some examples of applications of genome editing to therapeutic models, and the references of the below Table and the documents cited in those references are hereby incorporated herein by reference as if set out in full.

TABLE 6

| Disease Type | Nuclease Platform Employed | Therapeutic Strategy | References |
|---|---|---|---|
| Hemophilia B | ZFN | HDR-mediated insertion of correct gene sequence | Li, H., et al. Nature 475, 217-221 (2011) |
| SCID | ZFN | HDR-mediated insertion of correct gene sequence | Genovese, P., et al. Nature 510, 235-240 (2014) |
| Hereditary tyrosinemia | CRISPR | HDR-mediated correction of mutation in liver | Yin, H., et al. Nature biotechnology 32, 551-553 (2014) |

Addressing each of the conditions of the foregoing table, using the system to target by either HDR-mediated correction of mutation, or HDR-mediated insertion of correct gene sequence, advantageously via a delivery system as herein, e.g., a particle delivery system, is within the ambit of the skilled person from this disclosure and the knowledge in the art. Thus, an embodiment comprehends contacting a Hemophilia B, SCID (e.g., SCID-X1, ADA-SCID) or Hereditary tyrosinemia mutation-carrying HSC with an gRNA-and-Cas protein containing particle targeting a genomic locus of interest as to Hemophilia B, SCID (e.g., SCID-X1, ADA-SCID) or Hereditary tyrosinemia (e.g., as in Li, Genovese or Yin). The particle also can contain a suitable HDR template to correct the mutation; or the HSC can be contacted with a second particle or a vector that contains or delivers the HDR template. In this regard, it is mentioned that Haemophilia B is an X-linked recessive disorder caused by loss-of-function mutations in the gene encoding Factor IX, a crucial component of the clotting cascade. Recovering Factor IX activity to above 1% of its levels in severely affected individuals can transform the disease into a significantly milder form, as infusion of recombinant Factor IX into such patients prophylactically from a young age to achieve such levels largely ameliorates clinical complications. With the knowledge in the art and the teachings in this disclosure, the skilled person can correct HSCs as to Haemophilia B using a system that targets and corrects the mutation (X-linked recessive disorder caused by loss-of-function mutations in the gene encoding Factor IX) (e.g., with a suitable HDR template that delivers a coding sequence for Factor IX); specifically, the gRNA can target mutation that give rise to Haemophilia B, and the HDR can provide coding for proper expression of Factor IX. An gRNA that targets the mutation-and-Cas protein containing particle is contacted with HSCs carrying the mutation. The particle also can contain a suitable HDR template to correct the mutation for proper expression of Factor IX; or the HSC can be contacted with a second particle or a vector that contains or delivers the HDR template. The so contacted cells can be administered; and optionally treated/expanded; cf. Cartier, discussed herein.

In Cartier, "MINI-SYMPOSIUM: X-Linked Adrenoleukodystrophypa, Hematopoietic Stem Cell Transplantation and Hematopoietic Stem Cell Gene Therapy in X-Linked Adrenoleukodystrophy," Brain Pathology 20 (2010) 857-862, incorporated herein by reference along with the documents it cites, as if set out in full, there is recognition that allogeneic hematopoietic stem cell transplantation (HSCT) was utilized to deliver normal lysosomal enzyme to the brain of a patient with Hurler's disease, and a discussion of HSC gene therapy to treat ALD. In two patients, peripheral CD34+ cells were collected after granulocyte-colony stimulating factor (G-CSF) mobilization and transduced with an myeloproliferative sarcoma virus enhancer, negative control region deleted, d1587rev primer binding site substituted (MND)-ALD lentiviral vector. CD34+ cells from the patients were transduced with the MND-ALD vector during 16 h in the presence of cytokines at low concentrations. Transduced CD34+ cells were frozen after transduction to perform on 5% of cells various safety tests that included in particular three replication-competent lentivirus (RCL) assays. Transduction efficacy of CD34+ cells ranged from 35% to 50% with a mean number of lentiviral integrated copy between 0.65 and 0.70. After the thawing of transduced CD34+ cells, the patients were reinfused with more than 4.106 transduced CD34+ cells/kg following full myeloablation with busulfan and cyclophos-phamide. The patient's HSCs were ablated to favor engraftment of the gene-corrected HSCs. Hematological recovery occurred between days 13 and 15 for the two patients. Nearly complete immunological recovery occurred at 12 months for the first patient, and at 9 months for the second patient. In contrast to using lentivirus, with the knowledge in the art and the teachings in this disclosure, the skilled person can correct HSCs as to ALD using a CRISPR-Cas (Type V) system that targets and corrects the mutation (e.g., with a suitable HDR template); specifically, the gRNA can target mutations in ABCD1, a gene located on the X chromosome that codes for ALD, a peroxisomal membrane transporter protein, and the HDR can provide coding for proper expression of the protein. An gRNA that targets the mutation-and-Cas (Type V) protein containing particle is contacted with HSCs, e.g., CD34+ cells carrying the mutation as in Cartier. The particle also can contain a suitable HDR template to correct the mutation for expression of the peroxisomal membrane transporter protein; or the HSC can be contacted with a second particle or a vector that contains or delivers the HDR template. The so contacted cells optionally can be treated as in Cartier. The so contacted cells can be administered as in Cartier.

Mention is made of WO 2015/148860, through the teachings herein the invention comprehends methods and materials of these documents applied in conjunction with the teachings herein. In an aspect of blood-related disease gene therapy, methods and compositions for treating beta thalassemia may be adapted to the CRISPR-Cas system of the present invention (see, e.g., WO 2015/148860). In an embodiment, WO 2015/148860 involves the treatment or prevention of beta thalassemia, or its symptoms, e.g., by altering the gene for B-cell CLL/lymphoma 11A (BCL11A). The BCL11A gene is also known as B-cell CLL/lymphoma 11A, BCL11A-L, BCL11A-S, BCL11AXL, CTIP 1, HBFQTLS and ZNF. BCL11A encodes a zinc-finger protein that is involved in the regulation of globin gene expression. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating beta thalassemia disease phenotypes.

Mention is also made of WO 2015/148863 and through the teachings herein the invention comprehends methods and materials of these documents which may be adapted to the CRISPR-Cas system of the present invention. In an aspect of treating and preventing sickle cell disease, which is an inherited hematologic disease, WO 2015/148863 comprehends altering the BCL11A gene. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating sickle cell disease phenotypes. Other targets that might be similarly modified are MYB, and KLF1.

In an aspect of the invention, methods and compositions which involve editing a target nucleic acid sequence, or modulating expression of a target nucleic acid sequence, and applications thereof in connection with cancer immunotherapy, are comprehended by adapting the CRISPR-Cas system of the present invention. Reference is made to the application of gene therapy in WO 2015/161276 which involves methods and compositions which can be used to affect T-cell proliferation, survival and/or function by altering one or more T-cell expressed genes, e.g., one or more of FAS, BID, CTLA4, PDCD1, CBLB, PTPN6, TRAC and/or TRBC genes. In a related aspect, T-cell proliferation can be affected by altering one or more T-cell expressed genes, e.g., the CBLB and/or PTPN6 gene, FAS and/or BID gene, CTLA4 and/or PDCDI and/or TRAC and/or TRBC gene.

Chimeric antigen receptor (CAR)19 T-cells exhibit anti-leukemic effects in patient malignancies. However, leukemia patients often do not have enough T-cells to collect, meaning that treatment must involve modified T cells from donors. Accordingly, there is interest in establishing a bank of donor T-cells. Qasim et al. ("First Clinical Application of Talen Engineered Universal CAR19 T Cells in B-ALL" ASH 57th Annual Meeting and Exposition, Dec. 5-8, 2015, Abstract 2046 (ash.confex.com/ash/2015/webprogram/Paper81653.html published online November 2015) discusses modifying CAR19 T cells to eliminate the risk of graft-versus-host disease through the disruption of T-cell receptor expression and CD52 targeting. Furthermore, CD52 cells were targeted such that they became insensitive to Alemtuzumab, and thus allowed Alemtuzumab to prevent host-mediated rejection of human leukocyte antigen (HLA) mismatched CAR19 T-cells. Investigators used third generation self-inactivating lentiviral vector encoding a 4 g7 CAR19 (CD19 scFv-4-1BB-CD3) linked to RQR8, then electroporated cells with two pairs of TALEN mRNA for multiplex targeting for both the T-cell receptor (TCR) alpha constant chain locus and the CD52 gene locus. Cells which were still expressing TCR following ex vivo expansion were depleted using CliniMacs α/β TCR depletion, yielding a T-cell product (UCART19) with <1% TCR expression, 85% of which expressed CAR19, and 64% becoming CD52 negative. The modified CAR19 T cells were administered to treat a patient's relapsed acute lymphoblastic leukemia. The teachings provided herein provide effective methods for providing modified hematopoietic stem cells and progeny thereof, including but not limited to cells of the myeloid and lymphoid lineages of blood, including T cells, B cells, monocytes, macrophages, neutrophils, basophils, eosinophils, erythrocytes, dendritic cells, and megakaryocytes or platelets, and natural killer cells and their precursors and progenitors. Such cells can be modified by knocking out, knocking in, or otherwise modulating targets, for example to remove or modulate CD52 as described above, and other targets, such as, without limitation, CXCR4, and PD-1. Thus compositions, cells, and method of the invention can be used to modulate immune responses and to treat, without limitation, malignancies, viral infections, and immune disorders, in conjunction with modification of administration of T cells or other cells to patients.

Mention is made of WO 2015/148670 and through the teachings herein the invention comprehends methods and materials of this document applied in conjunction with the teachings herein. In an aspect of gene therapy, methods and compositions for editing of a target sequence related to or in connection with Human Immunodeficiency Virus (HIV) and Acquired Immunodeficiency Syndrome (AIDS) are comprehended. In a related aspect, the invention described herein comprehends prevention and treatment of HIV infection and AIDS, by introducing one or more mutations in the gene for C-C chemokine receptor type 5 (CCR5). The CCR5 gene is also known as CKR5, CCR-5, CD195, CKR-5, CCCKR5, CMKBR5, IDDM22, and CC-CKR-5. In a further aspect, the invention described herein comprehends provide for prevention or reduction of HIV infection and/or prevention or reduction of the ability for HIV to enter host cells, e.g., in subjects who are already infected. Exemplary host cells for HIV include, but are not limited to, CD4 cells, T cells, gut associated lymphatic tissue (GALT), macrophages, dendritic cells, myeloid precursor cell, and microglia. Viral entry into the host cells requires interaction of the viral glycoproteins gp41 and gp120 with both the CD4 receptor and a co-receptor, e.g., CCR5. If a co-receptor, e.g., CCR5, is not present on the surface of the host cells, the virus cannot bind and enter the host cells. The progress of the disease is thus impeded. By knocking out or knocking down CCR5 in the host cells, e.g., by introducing a protective mutation (such as a CCR5 delta 32 mutation), entry of the HIV virus into the host cells is prevented.

X-linked Chronic granulomatous disease (CGD) is a hereditary disorder of host defense due to absent or decreased activity of phagocyte NADPH oxidase. Using a system that targets and corrects the mutation (absent or decreased activity of phagocyte NADPH oxidase) (e.g., with a suitable HDR template that delivers a coding sequence for phagocyte NADPH oxidase); specifically, the gRNA can target mutation that gives rise to CGD (deficient phagocyte NADPH oxidase), and the HDR can provide coding for proper expression of phagocyte NADPH oxidase. An gRNA that targets the mutation-and-Cas protein containing particle is contacted with HSCs carrying the mutation. The particle also can contain a suitable HDR template to correct the mutation for proper expression of phagocyte NADPH oxidase; or the HSC can be contacted with a second particle or a vector that contains or delivers the HDR template. The so contacted cells can be administered; and optionally treated/expanded; cf. Cartier.

Fanconi anemia: Mutations in at least 15 genes (FANCA, FANCB, FANCC, FANCD1/BRCA2, FANCD2, FANCE, FANCF, FANCG, FANCI, FANCJ/BACH1/BRIP1, FANCL/PHF9/POG, FANCM, FANCN/PALB2, FANCO/Rad51C, and FANCP/SLX4/BTBD12) can cause Fanconi anemia. Proteins produced from these genes are involved in a cell process known as the FA pathway. The FA pathway is turned on (activated) when the process of making new copies of DNA, called DNA replication, is blocked due to DNA damage. The FA pathway sends certain proteins to the area of damage, which trigger DNA repair so DNA replication can continue. The FA pathway is particularly responsive to a certain type of DNA damage known as interstrand cross-links (ICLs). ICLs occur when two DNA building blocks (nucleotides) on opposite strands of DNA are abnormally attached or linked together, which stops the process of DNA replication. ICLs can be caused by a buildup of toxic substances produced in the body or by treatment with certain cancer therapy drugs. Eight proteins associated with Fanconi anemia group together to form a complex known as the FA core complex. The FA core complex activates two proteins, called FANCD2 and FANCI. The activation of these two proteins brings DNA repair proteins to the area of the ICL so the cross-link can be removed and DNA replication can continue. the FA core complex. More in particular, the FA core complex is a nuclear multiprotein complex consisting of FANCA, FANCB, FANCC, FANCE, FANCF, FANCG, FANCL, and FANCM, functions as an E3 ubiquitin ligase and mediates the activation of the ID complex, which is a heterodimer composed of FANCD2 and FANCI. Once monoubiquitinated, it interacts with classical tumor suppressors downstream of the FA pathway including FANCD1/BRCA2, FANCN/PALB2, FANCJ/BRIP1, and FANCO/Rad51C and thereby contributes to DNA repair via homologous recombination (HR). Eighty to 90 percent of FA cases are due to mutations in one of three genes, FANCA, FANCC, and FANCG. These genes provide instructions for producing components of the FA core complex. Mutations in such genes associated with the FA core complex will cause the complex to be nonfunctional and disrupt the entire FA pathway. As a result, DNA damage is not repaired efficiently and ICLs build up over time. Geiselhart, "Review Article, Disrupted Signaling through the Fanconi Anemia Pathway Leads to Dysfunctional Hematopoietic Stem Cell Biology: Underlying Mechanisms and Potential Therapeutic Strategies," Anemia Volume 2012 (2012), Article ID 265790, dx.doi.org/10.1155/2012/265790 discussed FA and an animal experiment involving intrafemoral injection of a lentivirus encoding the FANCC gene resulting in correction of HSCs in vivo. Using a CRISPR-Cas (Type V) system that targets and one or more of the mutations associated with FA, for instance a CRISPR-Cas (Type V) system having gRNA(s) and HDR template(s) that respectively targets one or more of the mutations of FANCA, FANCC, or FANCG that give rise to FA and provide corrective expression of one or more of FANCA, FANCC or FANCG; e.g., the gRNA can target a mutation as to FANCC, and the HDR can provide coding for proper expression of FANCC. An gRNA that targets the mutation(s) (e.g., one or more involved in FA, such as mutation(s) as to any one or more of FANCA, FANCC or FANCG)-and-Cas (Type V) protein containing particle is contacted with HSCs carrying the mutation(s). The particle also can contain a suitable HDR template(s) to correct the mutation for proper expression of one or more of the proteins involved in FA, such as any one or more of FANCA, FANCC or FANCG; or the HSC can be contacted with a second particle or a vector that contains or delivers the HDR template. The so contacted cells can be administered; and optionally treated/expanded; cf. Cartier.

The particle in the herein discussion (e.g., as to containing gRNA(s) and Cas, optionally HDR template(s), or HDR template(s); for instance as to Hemophilia B, SCID, SCID-X1, ADA-SCID, Hereditary tyrosinemia, β-thalassemia, X-linked CGD, Wiskott-Aldrich syndrome, Fanconi anemia, adrenoleukodystrophy (ALD), metachromatic leukodystrophy (MLD), HIV/AIDS, Immunodeficiency disorder, Hematologic condition, or genetic lysosomal storage disease) is advantageously obtained or obtainable from admixing an gRNA(s) and Cas protein mixture (optionally containing HDR template(s) or such mixture only containing HDR template(s) when separate particles as to template(s) is desired) with a mixture comprising or consisting essentially of or consisting of surfactant, phospholipid, biodegradable polymer, lipoprotein and alcohol (wherein one or more gRNA targets the genetic locus or loci in the HSC).

Indeed, the invention is especially suited for treating hematopoietic genetic disorders with genome editing, and immunodeficiency disorders, such as genetic immunodeficiency disorders, especially through using the particle technology herein-discussed. Genetic immunodeficiencies are diseases where genome editing interventions of the instant invention can successful. The reasons include: Hematopoietic cells, of which immune cells are a subset, are therapeutically accessible. They can be removed from the body and transplanted autologously or allogenically. Further, certain genetic immunodeficiencies, e.g., severe combined immunodeficiency (SCID), create a proliferative disadvantage for immune cells. Correction of genetic lesions causing SCID by rare, spontaneous 'reverse' mutations indicates that correcting even one lymphocyte progenitor may be sufficient to recover immune function in patients . . . / . . . / . . . /Users/t_kowalski/AppData/Local/Microsoft/Windows/Temporary Internet Files/Content.Outlook/GA8VY8LK/Treating SCID for Ellen.docx-_EN-REF_1 See Bousso, P., et al. Diversity, functionality, and stability of the T cell repertoire derived in vivo from a single human T cell precursor. Proceedings of the National Academy of Sciences of the United States of America 97, 274-278 (2000). The selective advantage for edited cells allows for even low levels of editing to result in a therapeutic effect. This effect of the instant invention can be seen in SCID, Wiskott-Aldrich Syndrome, and the other conditions mentioned herein, including other genetic hematopoietic disorders such as alpha- and beta-thalassemia, where hemoglobin deficiencies negatively affect the fitness of erythroid progenitors.

The activity of NHEJ and HDR DSB repair varies significantly by cell type and cell state. NHEJ is not highly regulated by the cell cycle and is efficient across cell types, allowing for high levels of gene disruption in accessible target cell populations. In contrast, HDR acts primarily during S/G2 phase, and is therefore restricted to cells that are actively dividing, limiting treatments that require precise genome modifications to mitotic cells [Ciccia, A. & Elledge, S. J. Molecular cell 40, 179-204 (2010); Chapman, J. R., et al. Molecular cell 47, 497-510 (2012)].

The efficiency of correction via HDR may be controlled by the epigenetic state or sequence of the targeted locus, or the specific repair template configuration (single vs. double stranded, long vs. short homology arms) used [Hacein-Bey-Abina, S., et al. The New England journal of medicine 346, 1185-1193 (2002); Gaspar, H. B., et al. Lancet 364, 2181-2187 (2004); Beumer, K. J., et al. G3 (2013)]. The relative activity of NHEJ and HDR machineries in target cells may also affect gene correction efficiency, as these pathways may compete to resolve DSBs [Beumer, K. J., et al. Proceedings of the National Academy of Sciences of the United States of America 105, 19821-19826 (2008)]. HDR also imposes a delivery challenge not seen with NHEJ strategies, as it requires the concurrent delivery of nucleases and repair templates. In practice, these constraints have so far led to low levels of HDR in therapeutically relevant cell types. Clinical translation has therefore largely focused on NHEJ strategies to treat disease, although proof-of-concept preclinical HDR treatments have now been described for mouse models of haemophilia B and hereditary tyrosinemia [Li, H., et al. Nature 475, 217-221 (2011); Yin, H., et al. Nature biotechnology 32, 551-553 (2014)].

Any given genome editing application may comprise combinations of proteins, small RNA molecules, and/or repair templates, making delivery of these multiple parts substantially more challenging than small molecule therapeutics. Two main strategies for delivery of genome editing tools have been developed: ex vivo and in vivo. In ex vivo treatments, diseased cells are removed from the body, edited and then transplanted back into the patient. Ex vivo editing has the advantage of allowing the target cell population to be well defined and the specific dosage of therapeutic molecules delivered to cells to be specified. The latter consideration may be particularly important when off-target modifications are a concern, as titrating the amount of nuclease may decrease such mutations (Hsu et al., 2013). Another advantage of ex vivo approaches is the typically high editing rates that can be achieved, due to the development of efficient delivery systems for proteins and nucleic acids into cells in culture for research and gene therapy applications.

There may be drawbacks with ex vivo approaches that limit application to a small number of diseases. For instance, target cells must be capable of surviving manipulation outside the body. For many tissues, like the brain, culturing cells outside the body is a major challenge, because cells either fail to survive, or lose properties necessary for their function in vivo. Thus, in view of this disclosure and the knowledge in the art, ex vivo therapy as to tissues with adult stem cell populations amenable to ex vivo culture and manipulation, such as the hematopoietic system, by the CRISPR-Cas (Type V) system are enabled. [Bunn, H. F. & Aster, J. Pathophysiology of blood disorders, (McGraw-Hill, New York, 2011)]

In vivo genome editing involves direct delivery of editing systems to cell types in their native tissues. In vivo editing allows diseases in which the affected cell population is not amenable to ex vivo manipulation to be treated. Furthermore, delivering nucleases to cells in situ allows for the treatment of multiple tissue and cell types. These properties probably allow in vivo treatment to be applied to a wider range of diseases than ex vivo therapies.

To date, in vivo editing has largely been achieved through the use of viral vectors with defined, tissue-specific tropism. Such vectors are currently limited in terms of cargo carrying capacity and tropism, restricting this mode of therapy to organ systems where transduction with clinically useful vectors is efficient, such as the liver, muscle and eye [Kotterman, M. A. & Schaffer, D. V. Nature reviews. Genetics 15, 445-451 (2014); Nguyen, T. H. & Ferry, N. Gene therapy 11 Suppl 1, S76-84 (2004); Boye, S. E., et al. Molecular therapy: the journal of the American Society of Gene Therapy 21, 509-519 (2013)].

A potential barrier for in vivo delivery is the immune response that may be created in response to the large amounts of virus necessary for treatment, but this phenomenon is not unique to genome editing and is observed with other virus based gene therapies [Bessis, N., et al. Gene therapy 11 Suppl 1, S10-17 (2004)]. It is also possible that peptides from editing nucleases themselves are presented on MHC Class I molecules to stimulate an immune response, although there is little evidence to support this happening at the preclinical level. Another major difficulty with this mode of therapy is controlling the distribution and consequently the dosage of genome editing nucleases in vivo, leading to off-target mutation profiles that may be difficult to predict. However, in view of this disclosure and the knowledge in the art, including the use of virus- and particle-based therapies being used in the treatment of cancers, in vivo modification of HSCs, for instance by delivery by either particle or virus, is within the ambit of the skilled person.

Ex Vivo Editing Therapy: The long standing clinical expertise with the purification, culture and transplantation of hematopoietic cells has made diseases affecting the blood system such as SCID, Fanconi anemia, Wiskott-Aldrich syndrome and sickle cell anemia the focus of ex vivo editing therapy. Another reason to focus on hematopoietic cells is that, thanks to previous efforts to design gene therapy for blood disorders, delivery systems of relatively high efficiency already exist. With these advantages, this mode of therapy can be applied to diseases where edited cells possess a fitness advantage, so that a small number of engrafted, edited cells can expand and treat disease. One such disease is HIV, where infection results in a fitness disadvantage to CD4+ T cells.

Ex vivo editing therapy has been recently extended to include gene correction strategies. The barriers to HDR ex vivo were overcome in a recent paper from Genovese and colleagues, who achieved gene correction of a mutated IL2RG gene in hematopoietic stem cells (HSCs) obtained from a patient suffering from SCID-X1 [Genovese, P., et al. Nature 510, 235-240 (2014)]. Genovese et. al. accomplished gene correction in HSCs using a multimodal strategy. First, HSCs were transduced using integration-deficient lentivirus containing an HDR template encoding a therapeutic cDNA for IL2RG. Following transduction, cells were electroporated with mRNA encoding ZFNs targeting a mutational hotspot in IL2RG to stimulate HDR based gene correction. To increase HDR rates, culture conditions were optimized with small molecules to encourage HSC division. With optimized culture conditions, nucleases and HDR templates, gene corrected HSCs from the SCID-X1 patient were obtained in culture at therapeutically relevant rates. HSCs from unaffected individuals that underwent the same gene correction procedure could sustain long-term hematopoiesis in mice, the gold standard for HSC function. HSCs are capable of giving rise to all hematopoietic cell types and can be autologously transplanted, making them an extremely valuable cell population for all hematopoietic genetic disorders [Weissman, I. L. & Shizuru, J. A. Blood 112, 3543-3553 (2008)]. Gene corrected HSCs could, in principle, be used to treat a wide range of genetic blood disorders making this study an exciting breakthrough for therapeutic genome editing.

In Vivo Editing Therapy: In vivo editing can be used advantageously from this disclosure and the knowledge in the art. For organ systems where delivery is efficient, there have already been a number of exciting preclinical therapeutic successes. The first example of successful in vivo editing therapy was demonstrated in a mouse model of haemophilia B [Li, H., et al. Nature 475, 217-221 (2011)]. As noted earlier, Haemophilia B is an X-linked recessive disorder caused by loss-of-function mutations in the gene encoding Factor IX, a crucial component of the clotting cascade. Recovering Factor IX activity to above 1% of its levels in severely affected individuals can transform the disease into a significantly milder form, as infusion of recombinant Factor IX into such patients prophylactically from a young age to achieve such levels largely ameliorates clinical complications [Lofqvist, T., et al. Journal of internal medicine 241, 395-400 (1997)]. Thus, only low levels of HDR gene correction are necessary to change clinical outcomes for patients. In addition, Factor IX is synthesized and secreted by the liver, an organ that can be transduced efficiently by viral vectors encoding editing systems.

Using hepatotropic adeno-associated viral (AAV) serotypes encoding ZFNs and a corrective HDR template, up to 7% gene correction of a mutated, humanized Factor IX gene in the murine liver was achieved [Li, H., et al. Nature 475, 217-221 (2011)]. This resulted in improvement of clot formation kinetics, a measure of the function of the clotting cascade, demonstrating for the first time that in vivo editing therapy is not only feasible, but also efficacious. As discussed herein, the skilled person is positioned from the teachings herein and the knowledge in the art, e.g., Li to address Haemophilia B with a particle-containing HDR template and a CRISPR-Cas system that targets the mutation of the X-linked recessive disorder to reverse the loss-of-function mutation.

Building on this study, other groups have recently used in vivo genome editing of the liver with CRISPR-Cas to successfully treat a mouse model of hereditary tyrosinemia and to create mutations that provide protection against cardiovascular disease. These two distinct applications demonstrate the versatility of this approach for disorders that involve hepatic dysfunction [Yin, H., et al. Nature biotechnology 32, 551-553 (2014); Ding, Q., et al. Circulation research 115, 488-492 (2014)]. Application of in vivo editing to other organ systems are necessary to prove that this strategy is widely applicable. Currently, efforts to optimize both viral and non-viral vectors are underway to expand the range of disorders that can be treated with this mode of therapy [Kotterman, M. A. & Schaffer, D. V. Nature reviews. Genetics 15, 445-451 (2014); Yin, H., et al. Nature reviews. Genetics 15, 541-555 (2014)]. As discussed herein, the skilled person is positioned from the teachings herein and the knowledge in the art, e.g., Yin to address hereditary tyrosinemia with a particle-containing HDR template and a CRISPR-Cas system that targets the mutation.

Targeted deletion, therapeutic applications: Targeted deletion of genes may be preferred. Preferred are, therefore, genes involved in immunodeficiency disorder, hematologic condition, or genetic lysosomal storage disease, e.g., Hemophilia B, SCID, SCID-X1, ADA-SCID, Hereditary tyrosinemia, β-thalassemia, X-linked CGD, Wiskott-Aldrich syndrome, Fanconi anemia, adrenoleukodystrophy (ALD), metachromatic leukodystrophy (MLD), HIV/AIDS, other metabolic disorders, genes encoding mis-folded proteins involved in diseases, genes leading to loss-of-function involved in diseases; generally, mutations that can be targeted in an HSC, using any herein-discussed delivery system, with the particle system considered advantageous.

In the present invention, the immunogenicity of the CRISPR enzyme in particular may be reduced following the approach first set out in Tangri et al. with respect to erythropoietin and subsequently developed. Accordingly, directed evolution or rational design may be used to reduce the immunogenicity of the CRISPR enzyme (for instance a Type V effector) in the host species (human or other species).

Genome editing: The Type V CRISPR/Cas systems of the present invention can be used to correct genetic mutations that were previously attempted with limited success using TALEN and ZFN and lentiviruses, including as herein discussed; see also WO2013163628.

Treating Disease of the Brain, Central Nervous and Immune Systems

The present invention also contemplates delivering the CRISPR-Cas system to the brain or neurons. For example, RNA interference (RNAi) offers therapeutic potential for this disorder by reducing the expression of HTT, the disease-causing gene of Huntington's disease (see, e.g., McBride et al., Molecular Therapy vol. 19 no. 12 Dec. 2011, pp. 2152-2162), therefore Applicant postulates that it may be used/and or adapted to the CRISPR-Cas system. The CRISPR-Cas system may be generated using an algorithm to reduce the off-targeting potential of antisense sequences. The CRISPR-Cas sequences may target either a sequence in exon 52 of mouse, rhesus or human huntingtin and expressed in a viral vector, such as AAV. Animals, including humans, may be injected with about three microinjections per hemisphere (six injections total): the first 1 mm rostral to the anterior commissure (12 µl) and the two remaining injections (12 µl and 10 µl, respectively) spaced 3 and 6 mm caudal to the first injection with 1e12 vg/ml of AAV at a rate of about 1 µl/minute, and the needle was left in place for an additional 5 minutes to allow the injectate to diffuse from the needle tip.

DiFiglia et al. (PNAS, Oct. 23, 2007, vol. 104, no. 43, 17204-17209) observed that single administration into the adult striatum of an siRNA targeting Htt can silence mutant Htt, attenuate neuronal pathology, and delay the abnormal behavioral phenotype observed in a rapid-onset, viral transgenic mouse model of HD. DiFiglia injected mice intrastriatally with 2 µl of Cy3-labeled cc-siRNA-Htt or unconjugated siRNA-Htt at 10 µM. A similar dosage of CRISPR Cas targeted to Htt may be contemplated for humans in the present invention, for example, about 5-10 ml of 10 µM CRISPR Cas targeted to Htt may be injected intrastriatally.

In another example, Boudreau et al. (Molecular Therapy vol. 17 no. 6 Jun. 2009) injects 5 µl of recombinant AAV serotype 2/1 vectors expressing htt-specific RNAi virus (at $4 \times 10^{12}$ viral genomes/ml) into the straiatum. A similar dosage of CRISPR Cas targeted to Htt may be contemplated for humans in the present invention, for example, about 10-20 ml of $4 \times 10^{12}$ viral genomes/ml) CRISPR Cas targeted to Htt may be injected intrastriatally.

In another example, a CRISPR Cas targeted to HTT may be administered continuously (see, e.g., Yu et al., Cell 150, 895-908, Aug. 31, 2012). Yu et al. utilizes osmotic pumps delivering 0.25 ml/hr (Model 2004) to deliver 300 mg/day of ss-siRNA or phosphate-buffered saline (PBS) (Sigma Aldrich) for 28 days, and pumps designed to deliver 0.5 µl/hr (Model 2002) were used to deliver 75 mg/day of the positive control MOE ASO for 14 days. Pumps (Durect Corporation) were filled with ss-siRNA or MOE diluted in sterile PBS and then incubated at 37° C. for 24 or 48 (Model 2004) hours prior to implantation. Mice were anesthetized with 2.5% isofluorane, and a midline incision was made at the base of the skull. Using stereotaxic guides, a cannula was implanted into the right lateral ventricle and secured with Loctite adhesive. A catheter attached to an Alzet osmotic mini pump was attached to the cannula, and the pump was placed subcutaneously in the midscapular area. The incision was closed with 5.0 nylon sutures. A similar dosage of CRISPR Cas targeted to Htt may be contemplated for humans in the present invention, for example, about 500 to 1000 g/day CRISPR Cas targeted to Htt may be administered.

In another example of continuous infusion, Stiles et al. (Experimental Neurology 233 (2012) 463-471) implanted an intraparenchymal catheter with a titanium needle tip into the right putamen. The catheter was connected to a SynchroMed® II Pump (Medtronic Neurological, Minneapolis, Minn.) subcutaneously implanted in the abdomen. After a 7 day infusion of phosphate buffered saline at 6 µL/day, pumps were re-filled with test article and programmed for continuous delivery for 7 days. About 2.3 to 11.52 mg/d of siRNA were infused at varying infusion rates of about 0.1 to 0.5 µL/min. A similar dosage of CRISPR Cas targeted to Htt may be contemplated for humans in the present invention, for example, about 20 to 200 mg/day CRISPR Cas targeted to Htt may be administered. In another example, the methods of US Patent Publication No. 20130253040 assigned to Sangamo may also be also be adapted from TALES to the nucleic acid-targeting system of the present invention for treating Huntington's Disease.

In another example, the methods of US Patent Publication No. 20130253040 (WO2013130824) assigned to Sangamo may also be also be adapted from TALES to the CRISPR Cas system of the present invention for treating Huntington's Disease.

WO2015089354 A1 in the name of The Broad Institute et al., hereby incorporated by reference, describes a targets for Huntington's Disease (HP). Possible target genes of CRISPR complex in regard to Huntington's Disease: PRKCE; IGF1; EP300; RCOR1; PRKCZ; HDAC4; and TGM2. Accordingly, one or more of PRKCE; IGF1; EP300; RCOR1; PRKCZ; HDAC4; and TGM2 may be selected as targets for Huntington's Disease in some embodiments of the present invention.

Other trinucleotide repeat disorders. These may include any of the following: Category I includes Huntington's disease (HD) and the spinocerebellar ataxias; Category II expansions are phenotypically diverse with heterogeneous expansions that are generally small in magnitude, but also found in the exons of genes; and Category III includes fragile X syndrome, myotonic dystrophy, two of the spinocerebellar ataxias, juvenile myoclonic epilepsy, and Friedreich's ataxia.

A further aspect of the invention relates to utilizing the system for correcting defects in the EMP2A and EMP2B genes that have been identified to be associated with Lafora disease. Lafora disease is an autosomal recessive condition which is characterized by progressive myoclonus epilepsy which may start as epileptic seizures in adolescence. A few cases of the disease may be caused by mutations in genes yet to be identified. The disease causes seizures, muscle spasms, difficulty walking, dementia, and eventually death. There is currently no therapy that has proven effective against disease progression. Other genetic abnormalities associated with epilepsy may also be targeted by the system and the underlying genetics is further described in Genetics of Epilepsy and Genetic Epilepsies, edited by Giuliano Avanzini, Jeffrey L. Noebels, Mariani Foundation Paediatric Neurology:20; 2009).

The methods of US Patent Publication No. 20110158957 assigned to Sangamo BioSciences, Inc. involved in inactivating T cell receptor (TCR) genes may also be modified to the system of the present invention. In another example, the methods of US Patent Publication No. 20100311124 assigned to Sangamo BioSciences, Inc. and US Patent Publication No. 20110225664 assigned to Cellectis, which are both involved in inactivating glutamine synthetase gene expression genes may also be modified to the system of the present invention.

Delivery options for the brain include encapsulation of CRISPR enzyme and guide RNA in the form of either DNA or RNA into liposomes and conjugating to molecular Trojan horses for trans-blood brain barrier (BBB) delivery. Molecular Trojan horses have been shown to be effective for delivery of B-gal expression vectors into the brain of non-human primates. The same approach can be used to delivery vectors containing CRISPR enzyme and guide RNA. For instance, Xia C F and Boado R J, Pardridge W M ("Antibody-mediated targeting of siRNA via the human insulin receptor using avidin-biotin technology." Mol Pharm. 2009 May-June; 6(3):747-51. doi: 10.1021/mp800194) describes how delivery of short interfering RNA (siRNA) to cells in culture, and in vivo, is possible with combined use of a receptor-specific monoclonal antibody (mAb) and avidin-biotin technology. The authors also report that because the bond between the targeting mAb and the siRNA is stable with avidin-biotin technology, and RNAi effects at distant sites such as brain are observed in vivo following an intravenous administration of the targeted siRNA.

Zhang et al. (Mol Ther. 2003 January; 7(1):11-8.)) describe how expression plasmids encoding reporters such as luciferase were encapsulated in the interior of an "artificial virus" comprised of an 85 nm pegylated immunoliposome, which was targeted to the rhesus monkey brain in vivo with a monoclonal antibody (MAb) to the human insulin receptor (HIR). The HIRMAb enables the liposome carrying the exogenous gene to undergo transcytosis across the blood-brain barrier and endocytosis across the neuronal plasma membrane following intravenous injection. The level of luciferase gene expression in the brain was 50-fold higher in the rhesus monkey as compared to the rat. Widespread neuronal expression of the beta-galactosidase gene in primate brain was demonstrated by both histochemistry and confocal microscopy. The authors indicate that this approach makes feasible reversible adult transgenics in 24 hours. Accordingly, the use of immunoliposome is preferred. These may be used in conjunction with antibodies to target specific tissues or cell surface proteins.

Alzheimer's Disease

US Patent Publication No. 20110023153, describes use of zinc finger nucleases to genetically modify cells, animals and proteins associated with Alzheimer's Disease. Once modified cells and animals may be further tested using known methods to study the effects of the targeted mutations on the development and/or progression of AD using measures commonly used in the study of AD—such as, without limitation, learning and memory, anxiety, depression, addiction, and sensory motor functions as well as assays that measure behavioral, functional, pathological, metabolic and biochemical function.

The present disclosure comprises editing of any chromosomal sequences that encode proteins associated with AD. The AD-related proteins are typically selected based on an experimental association of the AD-related protein to an AD disorder. For example, the production rate or circulating concentration of an AD-related protein may be elevated or depressed in a population having an AD disorder relative to a population lacking the AD disorder. Differences in protein levels may be assessed using proteomic techniques including but not limited to Western blot, immunohistochemical staining, enzyme linked immunosorbent assay (ELISA), and mass spectrometry. Alternatively, the AD-related proteins may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Examples of Alzheimer's disease associated proteins may include the very low density lipoprotein receptor protein (VLDLR) encoded by the VLDLR gene, the ubiquitin-like modifier activating enzyme 1 (UBA1) encoded by the UBA1 gene, or the NEDD8-activating enzyme E1 catalytic subunit protein (UBE1C) encoded by the UBA3 gene, for example.

By way of non-limiting example, proteins associated with AD include but are not limited to the proteins listed as follows: Chromosomal Sequence Encoded Protein ALAS2 Delta-aminolevulinate synthase 2 (ALAS2) ABCA1 ATP-binding cassette transporter (ABCA1) ACE Angiotensin I-converting enzyme (ACE) APOE Apolipoprotein E precursor (APOE) APP amyloid precursor protein (APP) AQP1 aquaporin 1 protein (AQP1) BIN1 Myc box-dependent-interacting protein 1 or bridging integrator 1 protein (BIN1) BDNF brain-derived neurotrophic factor (BDNF) BTNL8 Butyrophilin-like protein 8 (BTNL8) C1ORF49 chromosome 1 open reading frame 49 CDH4 Cadherin-4 CHRNB2 Neuronal acetylcholine receptor subunit beta-2 CKLFSF2 CKLF-like MARVEL transmembrane domain-containing protein 2 (CKLFSF2) CLEC4E C-type lectin domain family 4, member e (CLEC4E) CLU clusterin protein (also known as apoplipoprotein J) CR1 Erythrocyte complement receptor 1 (CR1, also known as CD35, C3b/C4b receptor and immune adherence receptor) CR1L Erythrocyte complement receptor 1 (CR1L) CSF3R granulocyte colony-stimulating factor 3 receptor (CSF3R) CST3 Cystatin C or cystatin 3 CYP2C Cytochrome P450 2C DAPK1 Death-associated protein kinase 1 (DAPK1) ESR1 Estrogen receptor 1 FCAR Fc fragment of IgA receptor (FCAR, also known as CD89) FCGR3B Fc fragment of IgG, low affinity IIIb, receptor (FCGR3B or CD16b) FFA2 Free fatty acid receptor 2 (FFA2) FGA Fibrinogen (Factor I) GAB2 GRB2-associated-binding protein 2 (GAB2) GAB2 GRB2-associated-binding protein 2 (GAB2) GALP Galanin-like peptide GAPDHS Glyceraldehyde-3-phosphate dehydrogenase, spermatogenic (GAPDHS) GMPB GMBP HP Haptoglobin (HP) HTR7 5-hydroxytryptamine (serotonin) receptor 7 (adenylate cyclase-coupled) IDE Insulin degrading enzyme IF127 IF127 IFI6 Interferon, alpha-inducible protein 6 (IFI6) IFIT2 Interferon-induced protein with tetratricopeptide repeats 2 (IFIT2) IL1RN interleukin-1 receptor antagonist (IL-1RA) IL8RA Interleukin 8 receptor, alpha (IL8RA or CD181) IL8RB Interleukin 8 receptor, beta (IL8RB) JAG1 Jagged 1 (JAG1) KCNJ15 Potassium inwardly-rectifying channel, subfamily J, member 15 (KCNJ15) LRP6 Low-density lipoprotein receptor-related protein 6 (LRP6) MAPT microtubule-associated protein tau (MAPT) MARK4 MAP/microtubule affinity-regulating kinase 4 (MARK4) MPHOSPH1 M-phase phosphoprotein 1 MTHFR 5,10-methylenetetrahydrofolate reductase MX2 Interferon-induced GTP-binding protein Mx2 NBN Nibrin, also known as NBN NCSTN Nicastrin NIACR2 Niacin receptor 2 (NIACR2, also known as GPR109B) NMNAT3 nicotinamide nucleotide adenylyltransferase 3 N™ Neurotrimin (or HNT) ORM1 Orosmucoid 1 (ORM1) or Alpha-1-acid glycoprotein 1 P2RY13 P2Y purinoceptor 13 (P2RY13) PBEF1 Nicotinamide phosphoribosyltransferase (NAmPRTase or Nampt) also known as pre-B-cell colony-enhancing factor 1 (PBEF1) or visfatin PCK1 Phosphoenolpyruvate carboxykinase PICALM phosphatidylinositol binding clathrin assembly protein (PICALM) PLAU Urokinase-type plasminogen activator (PLAU) PLXNC1 Plexin C1 (PLXNC1) PRNP Prion protein PSEN1 presenilin 1 protein (PSEN1) PSEN2 presenilin 2 protein (PSEN2) PTPRA protein tyrosine phosphatase receptor type A protein (PTPRA) RALGPS2 Ral GEF with PH domain and SH3 binding motif 2 (RALGPS2) RGSL2 regulator of G-protein signaling like 2 (RGSL2) SELENBP1 Selenium binding protein 1 (SELNBP1) SLC25A37 Mitoferrin-1 SORL1 sortilin-related receptor L(DLR class) A repeats-containing protein (SORL1) TF Transferrin TFAM Mitochondrial transcription factor A TNF Tumor necrosis factor TNFRSF10C Tumor necrosis factor receptor superfamily member 10C (TNFRSF10C) TNFSF10 Tumor necrosis factor receptor superfamily, (TRAIL) member 10a (TNFSF10) UBA1 ubiquitin-like modifier activating enzyme 1 (UBA1) UBA3 NEDD8-activating enzyme E1 catalytic subunit protein (UBE1C) UBB ubiquitin B protein (UBB) UBQLN1 Ubiquilin-1 UCHL1 ubiquitin carboxyl-terminal esterase L1 protein (UCHL1) UCHL3 ubiquitin carboxyl-terminal hydrolase isozyme L3 protein (UCHL3) VLDLR very low density lipoprotein receptor protein (VLDLR).

In exemplary embodiments, the proteins associated with AD whose chromosomal sequence is edited may be the very low density lipoprotein receptor protein (VLDLR) encoded by the VLDLR gene, the ubiquitin-like modifier activating enzyme 1 (UBA1) encoded by the UBA1 gene, the NEDD8-activating enzyme E1 catalytic subunit protein (UBE1C) encoded by the UBA3 gene, the aquaporin 1 protein (AQP1) encoded by the AQP1 gene, the ubiquitin carboxyl-terminal esterase L1 protein (UCHL1) encoded by the UCHL1 gene, the ubiquitin carboxyl-terminal hydrolase isozyme L3 protein (UCHL3) encoded by the UCHL3 gene, the ubiquitin B protein (UBB) encoded by the UBB gene, the microtubule-associated protein tau (MAPT) encoded by the MAPT gene, the protein tyrosine phosphatase receptor type A protein (PTPRA) encoded by the PTPRA gene, the phosphatidylinositol binding clathrin assembly protein (PICALM) encoded by the PICALM gene, the clusterin protein (also known as apoplipoprotein J) encoded by the CLU gene, the presenilin 1 protein encoded by the PSEN1 gene, the presenilin 2 protein encoded by the PSEN2 gene, the sortilin-related receptor L(DLR class) A repeats-containing protein (SORL1) protein encoded by the SORL1 gene, the amyloid precursor protein (APP) encoded by the APP gene, the Apolipoprotein E precursor (APOE) encoded by the APOE gene, or the brain-derived neurotrophic factor (BDNF) encoded by the BDNF gene. In an exemplary embodiment, the genetically modified animal is a rat, and the edited chromosomal sequence encoding the protein associated with AD is as as follows: APP amyloid precursor protein (APP) NM_019288 AQP1 aquaporin 1 protein (AQP1) NM_012778 BDNF Brain-derived neurotrophic factor NM_012513 CLU clusterin protein (also known as NM_053021 apoplipoprotein J) MAPT microtubule-associated protein NM_017212 tau (MAPT) PICALM phosphatidylinositol binding NM_053554 clathrin assembly protein (PICALM) PSEN1 presenilin 1 protein (PSEN1) NM_019163 PSEN2 presenilin 2 protein (PSEN2) NM_031087 PTPRA protein tyrosine phosphatase NM_012763 receptor type A protein (PTPRA) SORL1 sortilin-related receptor L(DLR NM_053519, class) A repeats-containing XM 001065506, protein (SORL1) XM_217115 UBA1 ubiquitin-like modifier activating NM_001014080 enzyme 1 (UBA1) UBA3 NEDD8-activating enzyme E1 NM_057205 catalytic subunit protein (UBE1C) UBB ubiquitin B protein (UBB) NM_138895 UCHL1 ubiquitin carboxyl-terminal NM_017237 esterase L1 protein (UCHL1) UCHL3 ubiquitin carboxyl-terminal NM_001110165 hydrolase isozyme L3 protein (UCHL3) VLDLR very low density lipoprotein NM_013155 receptor protein (VLDLR).

The animal or cell may comprise 1, 2, 3, 4, 5, 6, 7, 8, 9, 10, 11, 12, 13, 14, 15 or more disrupted chromosomal sequences encoding a protein associated with AD and zero, 1, 2, 3, 4, 5, 6, 7, 8, 9, 10, 11, 12, 13, 14, 15 or more chromosomally integrated sequences encoding a protein associated with AD.

The edited or integrated chromosomal sequence may be modified to encode an altered protein associated with AD. A number of mutations in AD-related chromosomal sequences have been associated with AD. For instance, the V7171 (i.e. valine at position 717 is changed to isoleucine) missense mutation in APP causes familial AD. Multiple mutations in the presenilin-1 protein, such as H163R (i.e. histidine at position 163 is changed to arginine), A246E (i.e. alanine at position 246 is changed to glutamate), L286V (i.e. leucine at position 286 is changed to valine) and C410Y (i.e. cysteine at position 410 is changed to tyrosine) cause familial Alzheimer's type 3. Mutations in the presenilin-2 protein, such as N141 I (i.e. asparagine at position 141 is changed to isoleucine), M239V (i.e. methionine at position 239 is changed to valine), and D439A (i.e. aspartate at position 439 is changed to alanine) cause familial Alzheimer's type 4. Other associations of genetic variants in AD-associated genes and disease are known in the art. See, for example, Waring et al. (2008) Arch. Neurol. 65:329-334, the disclosure of which is incorporated by reference herein in its entirety.

In certain example embodiments, the systems disclosed herein may be used to insert or replace a AD risk increasing variant, such as APOE4, with a neutral risk variant such as APOE3, ora risk-reducing variant such as APOE2.

Secretase Disorders

US Patent Publication No. 20110023146, describes use of zinc finger nucleases to genetically modify cells, animals and proteins associated with secretase-associated disorders. Secretases are essential for processing pre-proteins into their biologically active forms. Defects in various components of the secretase pathways contribute to many disorders, particularly those with hallmark amyloidogenesis or amyloid plaques, such as Alzheimer's disease (AD).

A secretase disorder and the proteins associated with these disorders are a diverse set of proteins that effect susceptibility for numerous disorders, the presence of the disorder, the severity of the disorder, or any combination thereof. The present disclosure comprises editing of any chromosomal sequences that encode proteins associated with a secretase disorder. The proteins associated with a secretase disorder are typically selected based on an experimental association of the secretase—related proteins with the development of a secretase disorder. For example, the production rate or circulating concentration of a protein associated with a secretase disorder may be elevated or depressed in a population with a secretase disorder relative to a population without a secretase disorder. Differences in protein levels may be assessed using proteomic techniques including but not limited to Western blot, immunohistochemical staining, enzyme linked immunosorbent assay (ELISA), and mass spectrometry. Alternatively, the protein associated with a secretase disorder may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with a secretase disorder include PSENEN (presenilin enhancer 2 homolog (*C. elegans*)), CTSB (cathepsin B), PSEN1 (presenilin 1), APP (amyloid beta (A4) precursor protein), APH1B (anterior pharynx defective 1 homolog B (*C. elegans*)), PSEN2 (presenilin 2 (Alzheimer disease 4)), BACE1 (beta-site APP-cleaving enzyme 1), ITM2B (integral membrane protein 2B), CTSD (cathepsin D), NOTCH1 (Notch homolog 1, translocation-associated (*Drosophila*)), TNF (tumor necrosis factor (TNF superfamily, member 2)), INS (insulin), DYT10 (dystonia 10), ADAM17 (ADAM metallopeptidase domain 17), APOE (apolipoprotein E), ACE (angiotensin I converting enzyme (peptidyl-dipeptidase A) 1), STN (statin), TP53 (tumor protein p53), IL6 (interleukin 6 (interferon, beta 2)), NGFR (nerve growth factor receptor (TNFR superfamily, member 16)), IL1B (interleukin 1, beta), ACHE (acetylcholinesterase (Yt blood group)), CTNNB1 (catenin (cadherin-associated protein), beta 1, 88 kDa), IGF1 (insulin-like growth factor 1 (somatomedin C)), IFNG (interferon, gamma), NRG1 (neuregulin 1), CASP3 (caspase 3, apoptosis-related cysteine peptidase), MAPK1 (mitogen-activated protein kinase 1), CDH1 (cadherin 1, type 1, E-cadherin (epithelial)), APBB1 (amyloid beta (A4) precursor protein-binding, family B, member 1 (Fe65)), HMGCR (3-hydroxy-3-methylglutaryl-Coenzyme A reductase), CREB1 (cAMP responsive element binding protein 1), PTGS2 (prostaglandin-endoperoxide synthase 2 (prostaglandin G/H synthase and cyclooxygenase)), HES1 (hairy and enhancer of split 1, (*Drosophila*)), CAT (catalase), TGFB1 (transforming growth factor, beta 1), ENO2 (enolase 2 (gamma, neuronal)), ERBB4 (v-erb-a erythroblastic leukemia viral oncogene homolog 4 (avian)), TRAPPC10 (trafficking protein particle complex 10), MAOB (monoamine oxidase B), NGF (nerve growth factor (beta polypeptide)), MMP12 (matrix metallopeptidase 12 (macrophage elastase)), JAG1 (jagged 1 (Alagille syndrome)), CD40LG (CD40 ligand), PPARG (peroxisome proliferator-activated receptor gamma), FGF2 (fibroblast growth factor 2 (basic)), IL3 (interleukin 3 (colony-stimulating factor, multiple)), LRP1 (low density lipoprotein receptor-related protein 1), NOTCH4 (Notch homolog 4 (*Drosophila*)), MAPK8 (mitogen-activated protein kinase 8), PREP (prolyl endopeptidase), NOTCH3 (Notch homolog 3 (*Drosophila*)), PRNP (prion protein), CTSG (cathepsin G), EGF (epidermal growth factor (beta-urogastrone)), REN (renin), CD44 (CD44 molecule (Indian blood group)), SELP (selectin P (granule membrane protein 140 kDa, antigen CD62)), GHR (growth hormone receptor), ADCYAP1 (adenylate cyclase activating polypeptide 1 (pituitary)), INSR (insulin receptor), GFAP (glial fibrillary acidic protein), MMP3 (matrix metallopeptidase 3 (stromelysin 1, progelatinase)), MAPK10 (mitogen-activated protein kinase 10), SP1 (Sp1 transcription factor), MYC (v-myc myelocytomatosis viral oncogene homolog (avian)), CTSE (cathepsin E), PPARA (peroxisome proliferator-activated receptor alpha), JUN (jun oncogene), TIMP1 (TIMP metallopeptidase inhibitor 1), IL5 (interleukin 5 (colony-stimulating factor, eosinophil)), ILIA (interleukin 1, alpha), MMP9 (matrix metallopeptidase 9 (gelatinase B, 92 kDa gelatinase, 92 kDa type IV collagenase)), HTR4 (5-hydroxytryptamine (serotonin) receptor 4), HSPG2 (heparan sulfate proteoglycan 2), KRAS (v-Ki-ras2 Kirsten rat sarcoma viral oncogene homolog), CYCS (cytochrome c, somatic), SMG1 (SMG1 homolog, phosphatidylinositol 3-kinase-related kinase (*C. elegans*)), IL1R1 (interleukin 1 receptor, type I), PROK1 (prokineticin 1), MAPK3 (mitogen-activated protein kinase 3), NTRK1 (neurotrophic tyrosine kinase, receptor, type 1), IL13 (interleukin 13), MME (membrane metallo-endopeptidase), TKT (transketolase), CXCR2 (chemokine (C—X—C motif) receptor 2), IGF1R (insulin-like growth factor 1 receptor), RARA (retinoic acid receptor, alpha), CREBBP (CREB binding protein), PTGS1 (prostaglandin-endoperoxide synthase 1 (prostaglandin G/H synthase and cyclooxygenase)), GALT (galactose-1-phosphate uridylyltransferase), CHRM1 (cholinergic receptor, muscarinic 1), ATXN1 (ataxin 1), PAWR (PRKC, apoptosis, WT1, regulator), NOTCH2 (Notch homolog 2 (*Drosophila*)), M6PR (mannose-6-phosphate receptor (cation dependent)), CYP46A1 (cytochrome P450, family 46, subfamily A, polypeptide 1), CSNK1 D (casein kinase 1, delta), MAPK14 (mitogen-activated protein kinase 14), PRG2 (proteoglycan 2, bone marrow (natural killer cell activator, eosinophil granule major basic protein)), PRKCA (protein kinase C, alpha), L1 CAM (L1 cell adhesion molecule), CD40 (CD40 molecule, TNF receptor superfamily member 5), NR1I2 (nuclear receptor subfamily 1, group I, member 2), JAG2 (jagged 2), CTNND1 (catenin (cadherin-associated protein), delta 1), CDH2 (cadherin 2, type 1, N-cadherin (neuronal)), CMA1 (chymase 1, mast cell), SORT1 (sortilin 1), DLK1 (delta-like 1 homolog (Drosophila)), THEM4 (thioesterase superfamily member 4), JUP (junction plakoglobin), CD46 (CD46 molecule, complement regulatory protein), CCL11 (chemokine (C—C motif) ligand 11), CAV3 (caveolin 3), RNASE3 (ribonuclease, RNase A family, 3 (eosinophil cationic protein)), HSPA8 (heat shock 70 kDa protein 8), CASP9 (caspase 9, apoptosis-related cysteine peptidase), CYP3A4 (cytochrome P450, family 3, subfamily A, polypeptide 4), CCR3 (chemokine (C—C motif) receptor 3), TFAP2A (transcription factor AP-2 alpha (activating enhancer binding protein 2 alpha)), SCP2 (sterol carrier protein 2), CDK4 (cyclin-dependent kinase 4), HIF1A (hypoxia inducible factor 1, alpha subunit (basic helix-loop-helix transcription factor)), TCF7L2 (transcription factor 7-like 2 (T-cell specific, HMG-box)), IL1R2 (interleukin 1 receptor, type II), B3GALTL (beta 1,3-galactosyltransferase-like), MDM2 (Mdm2 p53 binding protein homolog (mouse)), RELA (v-rel reticuloendotheliosis viral oncogene homolog A (avian)), CASP7 (caspase 7, apoptosis-related cysteine peptidase), IDE (insulin-degrading enzyme), FABP4 (fatty acid binding protein 4, adipocyte), CASK (calcium/calmodulin-dependent serine protein kinase (MAGUK family)), ADCYAP1R1 (adenylate cyclase activating polypeptide 1 (pituitary) receptor type I), ATF4 (activating transcription factor 4 (tax-responsive enhancer element B67)), PDGFA (platelet-derived growth factor alpha polypeptide), C21 or f33 (chromosome 21 open reading frame 33), SCGS (secretogranin V (7B2 protein)), RNF123 (ring finger protein 123), NFKB1 (nuclear factor of kappa light polypeptide gene enhancer in B-cells 1), ERBB2 (v-erb-b2 erythroblastic leukemia viral oncogene homolog 2, neuro/glioblastoma derived oncogene homolog (avian)), CAV1 (caveolin 1, caveolae protein, 22 kDa), MMP7 (matrix metallopeptidase 7 (matrilysin, uterine)), TGFA (transforming growth factor, alpha), RXRA (retinoid X receptor, alpha), STX1A (syntaxin 1A (brain)), PSMC4 (proteasome (prosome, macropain) 26S subunit, ATPase, 4), P2RY2 (purinergic receptor P2Y, G-protein coupled, 2), TNFRSF21 (tumor necrosis factor receptor superfamily, member 21), DLG1 (discs, large homolog 1 (Drosophila)), NUMBL (numb homolog (Drosophila)-like), SPN (sialophorin), PLSCR1 (phospholipid scramblase 1), UBQLN2 (ubiquilin 2), UBQLN1 (ubiquilin 1), PCSK7 (proprotein convertase subtilisin/kexin type 7), SPON1 (spondin 1, extracellular matrix protein), SILV (silver homolog (mouse)), QPCT (glutaminyl-peptide cyclotransferase), HESS (hairy and enhancer of split 5 (Drosophila)), GCC1 (GRIP and coiled-coil domain containing 1), and any combination thereof.

The genetically modified animal or cell may comprise 1, 2, 3, 4, 5, 6, 7, 8, 9, 10 or more disrupted chromosomal sequences encoding a protein associated with a secretase disorder and zero, 1, 2, 3, 4, 5, 6, 7, 8, 9, 10 or more chromosomally integrated sequences encoding a disrupted protein associated with a secretase disorder.

ALS

US Patent Publication No. 20110023144, describes use of zinc finger nucleases to genetically modify cells, animals and proteins associated with amyotrophyic lateral sclerosis (ALS) disease. ALS is characterized by the gradual steady degeneration of certain nerve cells in the brain cortex, brain stem, and spinal cord involved in voluntary movement.

Motor neuron disorders and the proteins associated with these disorders are a diverse set of proteins that effect susceptibility for developing a motor neuron disorder, the presence of the motor neuron disorder, the severity of the motor neuron disorder or any combination thereof. The present disclosure comprises editing of any chromosomal sequences that encode proteins associated with ALS disease, a specific motor neuron disorder. The proteins associated with ALS are typically selected based on an experimental association of ALS—related proteins to ALS. For example, the production rate or circulating concentration of a protein associated with ALS may be elevated or depressed in a population with ALS relative to a population without ALS. Differences in protein levels may be assessed using proteomic techniques including but not limited to Western blot, immunohistochemical staining, enzyme linked immunosorbent assay (ELISA), and mass spectrometry. Alternatively, the proteins associated with ALS may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with ALS include but are not limited to the following proteins: SOD1 superoxide dismutase 1, ALS3 amyotrophic lateral soluble sclerosis 3 SETX senataxin ALS5 amyotrophic lateral sclerosis 5 FUS fused in sarcoma ALS7 amyotrophic lateral sclerosis 7 ALS2 amyotrophic lateral DPP6 Dipeptidyl-peptidase 6 sclerosis 2 NEFH neurofilament, heavy PTGS1 prostaglandin-polypeptide endoperoxide synthase 1 SLC1A2 solute carrier family 1 TNFRSF10B tumor necrosis factor (glial high affinity receptor superfamily, glutamate transporter), member 10b member 2 PRPH peripherin HSP90AA1 heat shock protein 90 kDa alpha (cytosolic), class A member 1 GRIA2 glutamate receptor, IFNG interferon, gamma ionotropic, AMPA 2 S 100B S100 calcium binding FGF2 fibroblast growth factor 2 protein B AOX1 aldehyde oxidase 1 CS citrate synthase TARDBP TAR DNA binding protein TXN thioredoxin RAPH1 Ras association MAP3K5 mitogen-activated protein (RaIGDS/AF-6) and kinase 5 pleckstrin homology domains 1 NBEAL1 neurobeachin-like 1 GPX1 glutathione peroxidase 1 ICAIL islet cell autoantigen RAC1 ras-related C3 botulinum 1.69 kDa-like toxin substrate 1 MAPT microtubule-associated ITPR2 inositol 1,4,5-protein tau triphosphate receptor, type 2 ALS2CR4 amyotrophic lateral GLS glutaminase sclerosis 2 (juvenile) chromosome region, candidate 4 ALS2CR8 amyotrophic lateral CNTFR ciliary neurotrophic factor sclerosis 2 (juvenile) receptor chromosome region, candidate 8 ALS2CR11 amyotrophic lateral FOLH1 folate hydrolase 1 sclerosis 2 (juvenile) chromosome region, candidate 11 FAM117B family with sequence P4HB prolyl 4-hydroxylase, similarity 117, member B beta polypeptide CNTF ciliary neurotrophic factor SQSTM1 sequestosome 1 STRADB STE20-related kinase NAIP NLR family, apoptosis adaptor beta inhibitory protein YWHAQ tyrosine 3-SLC33A1 solute carrier family 33 monooxygenase/tryptoph (acetyl-CoA transporter), an 5-monooxygenase member 1 activation protein, theta polypeptide TRAK2 trafficking protein, homolog, SAC1 kinesin binding 2 lipid phosphatase domain containing NIF3L1 NIF3 NGG1 interacting INA internexin neuronal factor 3-like 1 intermediate filament protein, alpha PARD3B par-3 partitioning COX8A cytochrome c oxidase defective 3 homolog B subunit VIIIA CDK15 cyclin-dependent kinase HECW1 HECT, C2 and WW 15 domain containing E3 ubiquitin protein ligase 1 NOS1 nitric oxide synthase 1 MET met proto-oncogene SOD2 superoxide dismutase 2, HSPB1 heat shock 27 kDa mitochondrial protein 1 NEFL neurofilament, light CTSB cathepsin B polypeptide ANG angiogenin, HSPA8 heat shock 70 kDa ribonuclease, RNase A protein 8 family, 5

VAPB VAMP (vesicle-ESR1 estrogen receptor 1 associated membrane protein)-associated protein B and C SNCA synuclein, alpha HGF hepatocyte growth factor CAT catalase ACTB actin, beta NEFM neurofilament, medium TH tyrosine hydroxylase polypeptide BCL2 B-cell CLL/lymphoma 2 FAS Fas (TNF receptor superfamily, member 6) CASP3 caspase 3, apoptosis-CLU clusterin related cysteine peptidase SMN1 survival of motor neuron G6PD glucose-6-phosphate 1, telomeric dehydrogenase BAX BCL2-associated X HSF1 heat shock transcription protein factor 1 RNF19A ring finger protein 19A JUN jun oncogene ALS2CR12 amyotrophic lateral HSPA5 heat shock 70 kDa sclerosis 2 (juvenile) protein 5 chromosome region, candidate 12 MAPK14 mitogen-activated protein IL10 interleukin 10 kinase 14 APEX1 APEX nuclease TXNRD1 thioredoxin reductase 1 (multifunctional DNA repair enzyme) 1 NOS2 nitric oxide synthase 2, TIMP1 TIMP metallopeptidase inducible inhibitor 1 CASP9 caspase 9, apoptosis-XIAP X-linked inhibitor of related cysteine apoptosis peptidase GLG1 golgi glycoprotein 1 EPO erythropoietin VEGFA vascular endothelial ELN elastin growth factor A GDNF glial cell derived NFE2L2 nuclear factor (erythroid-neurotrophic factor derived 2)-like 2 SLC6A3 solute carrier family 6 HSPA4 heat shock 70 kDa (neurotransmitter protein 4 transporter, dopamine), member 3 APOE apolipoprotein E PSMB8 proteasome (prosome, macropain) subunit, beta type, 8 DCTN1 dynactin 1 TIMP3 TIMP metallopeptidase inhibitor 3 KIFAP3 kinesin-associated SLC1A1 solute carrier family 1 protein 3 (neuronal/epithelial high affinity glutamate transporter, system Xag), member 1 SMN2 survival of motor neuron CCNC cyclin C 2, centromeric MPP4 membrane protein, STUB1 STIP1 homology and U-palmitoylated 4 box containing protein 1 ALS2 amyloid beta (A4) PRDX6 peroxiredoxin 6 precursor protein SYP synaptophysin CABIN1 calcineurin binding protein 1 CASP1 caspase 1, apoptosis-GART phosphoribosylglycinami related cysteine de formyltransferase, peptidase phosphoribosylglycinami de synthetase, phosphoribosylaminoimi dazole synthetase CDKS cyclin-dependent kinase 5 ATXN3 ataxin 3 RTN4 reticulon 4 ClQB complement component 1, q subcomponent, B chain VEGFC nerve growth factor HTT huntingtin receptor PARK? Parkinson disease 7 XDH xanthine dehydrogenase GFAP glial fibrillary acidic MAP2 microtubule-associated protein protein 2 CYCS cytochrome c, somatic FCGR3B Fc fragment of IgG, low affinity IIIb, CCS copper chaperone for UBLS ubiquitin-like 5 superoxide dismutase MMP9 matrix metallopeptidase SLC18A3 solute carrier family 18 9 ((vesicular acetylcholine), member 3 TRPM7 transient receptor HSPB2 heat shock 27 kDa potential cation channel, protein 2 subfamily M, member 7 AKT1 v-akt murine thymoma DERL1 Derl-like domain family, viral oncogene homolog 1 member 1 CCL2 chemokine (C—C motif) NGRN neugrin, neurite ligand 2 outgrowth associated GSR glutathione reductase TPPP3 tubulin polymerization-promoting protein family member 3 APAF1 apoptotic peptidase BTBD10 BTB (POZ) domain activating factor 1 containing 10 GLUD1 glutamate CXCR4 chemokine (C—X—C motif) dehydrogenase 1 receptor 4 SLC1A3 solute carrier family 1 FLT1 fms-related tyrosine (glial high affinity glutamate transporter), member 3 kinase 1 PON1 paraoxonase 1 AR androgen receptor LIF leukemia inhibitory factor ERBB3 v-erb-b2 erythroblastic leukemia viral oncogene homolog 3 LGALS1 lectin, galactoside-CD44 CD44 molecule binding, soluble, 1 TP53 tumor protein p53 TLR3 toll-like receptor 3 GRIA1 glutamate receptor, GAPDH glyceraldehyde-3-ionotropic, AMPA 1 phosphate dehydrogenase GRIK1 glutamate receptor, DES desmin ionotropic, kainate 1 CHAT choline acetyltransferase FLT4 fms-related tyrosine kinase 4 CHMP2B chromatin modifying BAG1 BCL2-associated protein 2B athanogene MT3 metallothionein 3 CHRNA4 cholinergic receptor, nicotinic, alpha 4 GSS glutathione synthetase BAK1 BCL2-antagonist/killer 1 KDR kinase insert domain GSTP1 glutathione S-transferase receptor (a type III pi 1 receptor tyrosine kinase) OGG1 8-oxoguanine DNA IL6 interleukin 6 (interferon, glycosylase beta 2).

The animal or cell may comprise 1, 2, 3, 4, 5, 6, 7, 8, 9, 10 or more disrupted chromosomal sequences encoding a protein associated with ALS and zero, 1, 2, 3, 4, 5, 6, 7, 8, 9, 10 or more chromosomally integrated sequences encoding the disrupted protein associated with ALS. Preferred proteins associated with ALS include SOD1 (superoxide dismutase 1), ALS2 (amyotrophic lateral sclerosis 2), FUS (fused in sarcoma), TARDBP (TAR DNA binding protein), VAGFA (vascular endothelial growth factor A), VAGFB (vascular endothelial growth factor B), and VAGFC (vascular endothelial growth factor C), and any combination thereof.

Autism

US Patent Publication No. 20110023145, describes use of zinc finger nucleases to genetically modify cells, animals and proteins associated with autism spectrum disorders (ASD). Autism spectrum disorders (ASDs) are a group of disorders characterized by qualitative impairment in social interaction and communication, and restricted repetitive and stereotyped patterns of behavior, interests, and activities. The three disorders, autism, Asperger syndrome (AS) and pervasive developmental disorder-not otherwise specified (PDD-NOS) are a continuum of the same disorder with varying degrees of severity, associated intellectual functioning and medical conditions. ASDs are predominantly genetically determined disorders with a heritability of around 90%.

US Patent Publication No. 20110023145 comprises editing of any chromosomal sequences that encode proteins associated with ASD which may be applied to the system of the present invention. The proteins associated with ASD are typically selected based on an experimental association of the protein associated with ASD to an incidence or indication of an ASD. For example, the production rate or circulating concentration of a protein associated with ASD may be elevated or depressed in a population having an ASD relative to a population lacking the ASD. Differences in protein levels may be assessed using proteomic techniques including but not limited to Western blot, immunohistochemical staining, enzyme linked immunosorbent assay (ELISA), and mass spectrometry. Alternatively, the proteins associated with ASD may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Non limiting examples of disease states or disorders that may be associated with proteins associated with ASD include autism, Asperger syndrome (AS), pervasive developmental disorder-not otherwise specified (PDD-NOS), Rett's syndrome, tuberous sclerosis, phenylketonuria, Smith-Lemli-Opitz syndrome and fragile X syndrome. By way of non-limiting example, proteins associated with ASD include but are not limited to the following proteins: ATP10C aminophospholipid-MET MET receptor transporting ATPase tyrosine kinase (ATP10C) BZRAP1 MGLUR5 (GRM5) Metabotropic glutamate receptor 5 (MGLUR5)

CDH10 Cadherin-10 MGLUR6 (GRM6) Metabotropic glutamate receptor 6 (MGLUR6) CDH9 Cadherin-9 NLGN1 Neuroligin-1 CNTN4 Contactin-4 NLGN2 Neuroligin-2 CNTNAP2 Contactin-associated SEMA5A Neuroligin-3 protein-like 2 (CNTNAP2) DHCR7 7-dehydrocholesterol NLGN4X Neuroligin-4 X-reductase (DHCR7) linked DOC2A Double C2-like domain-NLGN4Y Neuroligin-4 Y-containing protein alpha linked DPP6 Dipeptidyl NLGN5 Neuroligin-5 aminopeptidase-like protein 6 EN2 engrailed 2 (EN2) NRCAM Neuronal cell adhesion molecule (NRCAM) MDGA2 fragile X mental retardation NRXN1 Neurexin-1 1 (MDGA2) FMR2 (AFF2) AF4/FMR2 family member 2 OR4M2 Olfactory receptor (AFF2) 4M2 FOXP2 Forkhead box protein P2 OR4N4 Olfactory receptor (FOXP2) 4N4 FXR1 Fragile X mental OXTR oxytocin receptor retardation, autosomal (OXTR) homolog 1 (FXR1) FXR2 Fragile X mental PAH phenylalanine retardation, autosomal hydroxylase (PAH) homolog 2 (FXR2) GABRA1 Gamma-aminobutyric acid PTEN Phosphatase and receptor subunit alpha-1 tensin homologue (GABRA1) (PTEN) GABRAS GABAA (.gamma.-aminobutyric PTPRZ1 Receptor-type acid) receptor alpha 5 tyrosine-protein subunit (GABRAS) phosphatase zeta (PTPRZ1) GABRB1 Gamma-aminobutyric acid RELN Reelin receptor subunit beta-1 (GABRB1) GABRB3 GABAA (.gamma.-aminobutyric RPL10 60S ribosomal acid) receptor.beta.3 subunit protein L10 (GABRB3) GABRG1 Gamma-aminobutyric acid SEMA5A Semaphorin-5A receptor subunit gamma-1 (SEMA5A) (GABRG1) HIRIP3 HIRA-interacting protein 3 SEZ6L2 seizure related 6 homolog (mouse)-like 2 HOXA1 Homeobox protein Hox-A1 SHANK3 SH3 and multiple (HOXA1) ankyrin repeat domains 3 (SHANK3) IL6 Interleukin-6 SHBZRAP1 SH3 and multiple ankyrin repeat domains 3 (SHBZRAP1) LAMB1 Laminin subunit beta-1 SLC6A4 Serotonin (LAMB1) transporter (SERT) MAPK3 Mitogen-activated protein TAS2R1 Taste receptor kinase 3 type 2 member 1 TAS2R1 MAZ Myc-associated zinc finger TSC1 Tuberous sclerosis protein protein 1 MDGA2 MAM domain containing TSC2 Tuberous sclerosis glycosylphosphatidylinositol protein 2 anchor 2 (MDGA2) MECP2 Methyl CpG binding UBE3A Ubiquitin protein protein 2 (MECP2) ligase E3A (UBE3A) MECP2 methyl CpG binding WNT2 Wingless-type protein 2 (MECP2) MMTV integration site family, member 2 (WNT2).

The identity of the protein associated with ASD whose chromosomal sequence is edited can and will vary. In preferred embodiments, the proteins associated with ASD whose chromosomal sequence is edited may be the benzodiazapine receptor (peripheral) associated protein 1 (BZRAP1) encoded by the BZRAP1 gene, the AF4/FMR2 family member 2 protein (AFF2) encoded by the AFF2 gene (also termed MFR2), the fragile X mental retardation autosomal homolog 1 protein (FXR1) encoded by the FXR1 gene, the fragile X mental retardation autosomal homolog 2 protein (FXR2) encoded by the FXR2 gene, the MAM domain containing glycosylphosphatidylinositol anchor 2 protein (MDGA2) encoded by the MDGA2 gene, the methyl CpG binding protein 2 (MECP2) encoded by the MECP2 gene, the metabotropic glutamate receptor 5 (MGLUR5) encoded by the MGLUR5-1 gene (also termed GRM5), the neurexin 1 protein encoded by the NRXN1 gene, or the semaphorin-5A protein (SEMA5A) encoded by the SEMA5A gene. In an exemplary embodiment, the genetically modified animal is a rat, and the edited chromosomal sequence encoding the protein associated with ASD is as listed below: BZRAP1 benzodiazapine receptor XM_002727789, (peripheral) associated XM_213427, protein 1 (BZRAP1) XM_002724533, XM_001081125 AFF2 (FMR2) AF4/FMR2 family member 2 XM_219832, (AFF2) XM_001054673 FXR1 Fragile X mental NM_001012179 retardation, autosomal homolog 1 (FXR1) FXR2 Fragile X mental NM_001100647 retardation, autosomal homolog 2 (FXR2) MDGA2 MAM domain containing NM_199269 glycosylphosphatidylinositol anchor 2 (MDGA2) MECP2 Methyl CpG binding NM_022673 protein 2 (MECP2) MGLUR5 Metabotropic glutamate NM_017012 (GRMS) receptor 5 (MGLUR5) NRXN1 Neurexin-1 NM_021767 SEMA5A Semaphorin-5A (SEMA5A) NM_001107659.

Trinucleotide Repeat Expansion Disorders

US Patent Publication No. 20110016540, describes use of zinc finger nucleases to genetically modify cells, animals and proteins associated with trinucleotide repeat expansion disorders. Trinucleotide repeat expansion disorders are complex, progressive disorders that involve developmental neurobiology and often affect cognition as well as sensori-motor functions.

Trinucleotide repeat expansion proteins are a diverse set of proteins associated with susceptibility for developing a trinucleotide repeat expansion disorder, the presence of a trinucleotide repeat expansion disorder, the severity of a trinucleotide repeat expansion disorder or any combination thereof. Trinucleotide repeat expansion disorders are divided into two categories determined by the type of repeat. The most common repeat is the triplet CAG, which, when present in the coding region of a gene, codes for the amino acid glutamine (Q). Therefore, these disorders are referred to as the polyglutamine (polyQ) disorders and comprise the following diseases: Huntington Disease (HD); Spinobulbar Muscular Atrophy (SBMA); Spinocerebellar Ataxias (SCA types 1, 2, 3, 6, 7, and 17); and Dentatorubro-Pallidoluysian Atrophy (DRPLA). The remaining trinucleotide repeat expansion disorders either do not involve the CAG triplet or the CAG triplet is not in the coding region of the gene and are, therefore, referred to as the non-polyglutamine disorders. The non-polyglutamine disorders comprise Fragile X Syndrome (FRAXA); Fragile XE Mental Retardation (FRAXE); Friedreich Ataxia (FRDA); Myotonic Dystrophy (DM); and Spinocerebellar Ataxias (SCA types 8, and 12).

The proteins associated with trinucleotide repeat expansion disorders are typically selected based on an experimental association of the protein associated with a trinucleotide repeat expansion disorder to a trinucleotide repeat expansion disorder. For example, the production rate or circulating concentration of a protein associated with a trinucleotide repeat expansion disorder may be elevated or depressed in a population having a trinucleotide repeat expansion disorder relative to a population lacking the trinucleotide repeat expansion disorder. Differences in protein levels may be assessed using proteomic techniques including but not limited to Western blot, immunohistochemical staining, enzyme linked immunosorbent assay (ELISA), and mass spectrometry. Alternatively, the proteins associated with trinucleotide repeat expansion disorders may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Non-limiting examples of proteins associated with trinucleotide repeat expansion disorders include AR (androgen receptor), FMR1 (fragile X mental retardation 1), HTT (huntingtin), DMPK (dystrophia myotonica-protein kinase), FXN (frataxin), ATXN2 (ataxin 2), ATN1 (atrophin 1), FEN1 (flap structure-specific endonuclease 1), TNRC6A (trinucleotide repeat containing 6A), PABPN1 (poly(A) binding protein, nuclear 1), JPH3 (junctophilin 3), MED15 (mediator complex subunit 15), ATXN1 (ataxin 1), ATXN3 (ataxin 3), TBP (TATA box binding protein), CACNA1A (calcium channel, voltage-dependent, P/Q type, alpha 1A subunit), ATXN8OS (ATXN8 opposite strand (non-protein coding)), PPP2R2B (protein phosphatase 2, regulatory subunit B, beta), ATXN7 (ataxin 7), TNRC6B (trinucleotide repeat containing 6B), TNRC6C (trinucleotide repeat containing 6C), CELF3 (CUGBP, Elav-like family member 3), MAB21L1 (mab-21-like 1 (*C. elegans*)), MSH2 (mutS homolog 2, colon cancer, nonpolyposis type 1 (*E. coli*)), TMEM185A (transmembrane protein 185A), SIX5 (SIX homeobox 5), CNPY3 (canopy 3 homolog (zebrafish)), FRAXE (fragile site, folic acid type, rare, fra(X)(q28) E), GNB2 (guanine nucleotide binding protein (G protein), beta polypeptide 2), RPL14 (ribosomal protein L14), ATXN8 (ataxin 8), INSR (insulin receptor), TTR (transthyretin), EP400 (E1A binding protein p400), GIGYF2 (GRB10 interacting GYF protein 2), OGG1 (8-oxoguanine DNA glycosylase), STC1 (stanniocalcin 1), CNDP1 (carnosine dipeptidase 1 (metallopeptidase M20 family)), C1Orf2 (chromosome 10 open reading frame 2), MAML3 master-mind-like 3 (*Drosophila*), DKC1 (dyskeratosis congenita 1, dyskerin), PAXIP1 (PAX interacting (with transcription-activation domain) protein 1), CASK (calcium/calmodulin-dependent serine protein kinase (MAGUK family)), MAPT (microtubule-associated protein tau), SP1 (Sp1 transcription factor), POLG (polymerase (DNA directed), gamma), AFF2 (AF4/FMR2 family, member 2), THBS1 (thrombospondin 1), TP53 (tumor protein p53), ESR1 (estrogen receptor 1), CGGBP1 (CGG triplet repeat binding protein 1), ABT1 (activator of basal transcription 1), KLK3 (kallikrein-related peptidase 3), PRNP (prion protein), JUN (jun oncogene), KCNN3 (potassium intermediate/small conductance calcium-activated channel, subfamily N, member 3), BAX (BCL2-associated X protein), FRAXA (fragile site, folic acid type, rare, fra(X)(q27.3) A (macroorchidism, mental retardation)), KBTBD10 (kelch repeat and BTB (POZ) domain containing 10), MBNL1 (muscleblind-like (*Drosophila*)), RAD51 (RAD51 homolog (RecA homolog, *E. coli*) (*S. cerevisiae*)), NCOA3 (nuclear receptor coactivator 3), ERDA1 (expanded repeat domain, CAG/CTG 1), TSC1 (tuberous sclerosis 1), COMP (cartilage oligomeric matrix protein), GCLC (glutamate-cysteine ligase, catalytic subunit), RRAD (Ras-related associated with diabetes), MSH3 (mutS homolog 3 (*E. coli*)), DRD2 (dopamine receptor D2), CD44 (CD44 molecule (Indian blood group)), CTCF (CCCTC-binding factor (zinc finger protein)), CCND1 (cyclin D1), CLSPN (claspin homolog (*Xenopus laevis*)), MEF2A (myocyte enhancer factor 2A), PTPRU (protein tyrosine phosphatase, receptor type, U), GAPDH (glyceraldehyde-3-phosphate dehydrogenase), TRIM22 (tripartite motif-containing 22), WT1 (Wilms tumor 1), AHR (aryl hydrocarbon receptor), GPX1 (glutathione peroxidase 1), TPMT (thiopurine S-methyltransferase), NDP (Norrie disease (pseudoglioma)), ARX (aristaless related homeobox), MUS81 (MUS81 endonuclease homolog (*S. cerevisiae*)), TYR (tyrosinase (oculocutaneous albinism IA)), EGR1 (early growth response 1), UNG (uracil-DNA glycosylase), NUMBL (numb homolog (*Drosophila*)-like), FABP2 (fatty acid binding protein 2, intestinal), EN2 (engrailed homeobox 2), CRYGC (crystallin, gamma C), SRP14 (signal recognition particle 14 kDa (homologous Alu RNA binding protein)), CRYGB (crystallin, gamma B), PDCD1 (programmed cell death 1), HOXA1 (homeobox A1), ATXN2L (ataxin 2-like), PMS2 (PMS2 postmeiotic segregation increased 2 (*S. cerevisiae*)), GLA (galactosidase, alpha), CBL (Cas-Br-M (murine) ecotropic retroviral transforming sequence), FTH1 (ferritin, heavy polypeptide 1), IL12RB2 (interleukin 12 receptor, beta 2), OTX2 (orthodenticle homeobox 2), HOXA5 (homeobox A5), POLG2 (polymerase (DNA directed), gamma 2, accessory subunit), DLX2 (distal-less homeobox 2), SIRPA (signal-regulatory protein alpha), OTX1 (orthodenticle homeobox 1), AHRR (aryl-hydrocarbon receptor repressor), MANF (mesencephalic astrocyte-derived neurotrophic factor), TMEM158 (transmembrane protein 158 (gene/pseudogene)), and ENSG00000078687.

Preferred proteins associated with trinucleotide repeat expansion disorders include HTT (Huntingtin), AR (androgen receptor), FXN (frataxin), Atxn3 (ataxin), Atxn1 (ataxin), Atxn2 (ataxin), Atxn7 (ataxin), Atxn10 (ataxin), DMPK (dystrophia myotonica-protein kinase), Atn1 (atrophin 1), CBP (creb binding protein), VLDLR (very low density lipoprotein receptor), and any combination thereof.

Treating Auditory Diseases

The present invention also contemplates delivering the system to one or both ears.

Researchers are looking into whether gene therapy could be used to aid current deafness treatments—namely, cochlear implants. Deafness is often caused by lost or damaged hair cells that cannot relay signals to auditory neurons. In such cases, cochlear implants may be used to respond to sound and transmit electrical signals to the nerve cells. But these neurons often degenerate and retract from the cochlea as fewer growth factors are released by impaired hair cells.

US patent application 20120328580 describes injection of a pharmaceutical composition into the ear (e.g., auricular administration), such as into the luminae of the cochlea (e.g., the Scala media, Sc vestibulae, and Sc tympani), e.g., using a syringe, e.g., a single-dose syringe. For example, one or more of the compounds described herein can be administered by intratympanic injection (e.g., into the middle ear), and/or injections into the outer, middle, and/or inner ear. Such methods are routinely used in the art, for example, for the administration of steroids and antibiotics into human ears. Injection can be, for example, through the round window of the ear or through the cochlear capsule. Other inner ear administration methods are known in the art (see, e.g., Salt and Plontke, Drug Discovery Today, 10:1299-1306, 2005).

In another mode of administration, the pharmaceutical composition can be administered in situ, via a catheter or pump. A catheter or pump can, for example, direct a pharmaceutical composition into the cochlear luminae or the round window of the ear and/or the lumen of the colon. Exemplary drug delivery apparatus and methods suitable for administering one or more of the compounds described herein into an ear, e.g., a human ear, are described by McKenna et al., (U.S. Publication No. 2006/0030837) and Jacobsen et al., (U.S. Pat. No. 7,206,639). In some embodiments, a catheter or pump can be positioned, e.g., in the ear (e.g., the outer, middle, and/or inner ear) of a patient during a surgical procedure. In some embodiments, a catheter or pump can be positioned, e.g., in the ear (e.g., the outer, middle, and/or inner ear) of a patient without the need for a surgical procedure.

Alternatively or in addition, one or more of the compounds described herein can be administered in combination with a mechanical device such as a cochlear implant or a hearing aid, which is worn in the outer ear. An exemplary cochlear implant that is suitable for use with the present invention is described by Edge et al., (U.S. Publication No. 2007/0093878).

In some embodiments, the modes of administration described above may be combined in any order and can be simultaneous or interspersed.

Alternatively or in addition, the present invention may be administered according to any of the Food and Drug Administration approved methods, for example, as described in CDER Data Standards Manual, version number 004 (which is available at fda.give/cder/dsm/DRG/drg00301.htm).

In general, the cell therapy methods described in US patent application 20120328580 can be used to promote complete or partial differentiation of a cell to or towards a mature cell type of the inner ear (e.g., a hair cell) in vitro. Cells resulting from such methods can then be transplanted or implanted into a patient in need of such treatment. The cell culture methods required to practice these methods, including methods for identifying and selecting suitable cell types, methods for promoting complete or partial differentiation of selected cells, methods for identifying complete or partially differentiated cell types, and methods for implanting complete or partially differentiated cells are described below.

Cells suitable for use in the present invention include, but are not limited to, cells that are capable of differentiating completely or partially into a mature cell of the inner ear, e.g., a hair cell (e.g., an inner and/or outer hair cell), when contacted, e.g., in vitro, with one or more of the compounds described herein. Exemplary cells that are capable of differentiating into a hair cell include, but are not limited to stem cells (e.g., inner ear stem cells, adult stem cells, bone marrow derived stem cells, embryonic stem cells, mesenchymal stem cells, skin stem cells, iPS cells, and fat derived stem cells), progenitor cells (e.g., inner ear progenitor cells), support cells (e.g., Deiters' cells, pillar cells, inner phalangeal cells, tectal cells and Hensen's cells), and/or germ cells. The use of stem cells for the replacement of inner ear sensory cells is described in Li et al., (U.S. Publication No. 2005/0287127) and Li et al., (U.S. patent Ser. No. 11/953, 797). The use of bone marrow derived stem cells for the replacement of inner ear sensory cells is described in Edge et al., PCT/US2007/084654. iPS cells are described, e.g., at Takahashi et al., Cell, Volume 131, Issue 5, Pages 861-872 (2007); Takahashi and Yamanaka, Cell 126, 663-76 (2006); Okita et al., Nature 448, 260-262 (2007); Yu, J. et al., Science 318(5858):1917-1920 (2007); Nakagawa et al., Nat. Biotechnol. 26:101-106 (2008); and Zaehres and Scholer, Cell 131(5):834-835 (2007). Such suitable cells can be identified by analyzing (e.g., qualitatively or quantitatively) the presence of one or more tissue specific genes. For example, gene expression can be detected by detecting the protein product of one or more tissue-specific genes. Protein detection techniques involve staining proteins (e.g., using cell extracts or whole cells) using antibodies against the appropriate antigen. In this case, the appropriate antigen is the protein product of the tissue-specific gene expression. Although, in principle, a first antibody (i.e., the antibody that binds the antigen) can be labeled, it is more common (and improves the visualization) to use a second antibody directed against the first (e.g., an anti-IgG). This second antibody is conjugated either with fluorochromes, or appropriate enzymes for colorimetric reactions, or gold beads (for electron microscopy), or with the biotin-avidin system, so that the location of the primary antibody, and thus the antigen, can be recognized.

The systems of the present invention may be delivered to the ear by direct application of pharmaceutical composition to the outer ear, with compositions modified from US Published application, 20110142917. In some embodiments the pharmaceutical composition is applied to the ear canal. Delivery to the ear may also be referred to as aural or otic delivery.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference.

Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Qi et al. discloses methods for efficient siRNA transfection to the inner ear through the intact round window by a novel proteidic delivery technology which may be applied to the nucleic acid-targeting system of the present invention (see, e.g., Qi et al., Gene Therapy (2013), 1-9). In particular, a TAT double stranded RNA-binding domains (TAT-DRBDs), which can transfect Cy3-labeled siRNA into cells of the inner ear, including the inner and outer hair cells, *crista ampullaris*, macula utriculi and macula sacculi, through intact round-window permeation was successful for delivering double stranded siRNAs in vivo for treating various inner ear ailments and preservation of hearing function. About 40 µl of 10 mM RNA may be contemplated as the dosage for administration to the ear.

According to Rejali et al. (Hear Res. 2007 June; 228(1-2):180-7), cochlear implant function can be improved by good preservation of the spiral ganglion neurons, which are the target of electrical stimulation by the implant and brain derived neurotrophic factor (BDNF) has previously been shown to enhance spiral ganglion survival in experimentally deafened ears. Rejali et al. tested a modified design of the cochlear implant electrode that includes a coating of fibroblast cells transduced by a viral vector with a BDNF gene insert. To accomplish this type of ex vivo gene transfer, Rejali et al. transduced guinea pig fibroblasts with an adenovirus with a BDNF gene cassette insert, and determined that these cells secreted BDNF and then attached BDNF-secreting cells to the cochlear implant electrode via an agarose gel, and implanted the electrode in the scala tympani. Rejali et al. determined that the BDNF expressing electrodes were able to preserve significantly more spiral ganglion neurons in the basal turns of the cochlea after 48 days of implantation when compared to control electrodes and demonstrated the feasibility of combining cochlear implant therapy with ex vivo gene transfer for enhancing spiral ganglion neuron survival. Such a system may be applied to the nucleic acid-targeting system of the present invention for delivery to the ear.

Mukherjea et al. (Antioxidants & Redox Signaling, Volume 13, Number 5, 2010) document that knockdown of NOX3 using short interfering (si) RNA abrogated cisplatin ototoxicity, as evidenced by protection of OHCs from damage and reduced threshold shifts in auditory brainstem responses (ABRs). Different doses of siNOX3 (0.3, 0.6, and 0.9 µg) were administered to rats and NOX3 expression was evaluated by real time RT-PCR. The lowest dose of NOX3 siRNA used (0.3 µg) did not show any inhibition of NOX3 mRNA when compared to transtympanic administration of scrambled siRNA or untreated *cochleae*. However, administration of the higher doses of NOX3 siRNA (0.6 and 0.9 µg) reduced NOX3 expression compared to control scrambled siRNA. Such a system may be applied to the system of the present invention for transtympanic administration with a dosage of about 2 mg to about 4 mg of CRISPR Cas for administration to a human. Jung et al. (Molecular Therapy, vol. 21 no. 4, 834-841 April 2013) demonstrate that HesS levels in the utricle decreased after the application of siRNA and that the number of hair cells in these utricles was significantly larger than following control treatment. The data suggest that siRNA technology may be useful for inducing repair and regeneration in the inner ear and that the Notch signaling pathway is a potentially useful target for specific gene expression inhibition. Jung et al. injected 8 µg of HesS siRNA in 2 µl volume, prepared by adding sterile normal saline to the lyophilized siRNA to a vestibular epithelium of the ear. Such a system may be applied to the nucleic acid-targeting system of the present invention for administration to the vestibular epithelium of the ear with a dosage of about 1 to about 30 mg of CRISPR Cas for administration to a human.

Gene Targeting in Non-Dividing Cells (Neurons & Muscle)

Non-dividing (especially non-dividing, fully differentiated) cell types present issues for gene targeting or genome engineering, for example because homologous recombination (HR) is generally suppressed in the G1 cell-cycle phase. However, while studying the mechanisms by which cells control normal DNA repair systems, Durocher discovered a previously unknown switch that keeps HR "off" in non-dividing cells and devised a strategy to toggle this switch back on. Orthwein et al. (Daniel Durocher's lab at the Mount Sinai Hospital in Ottawa, Canada) recently reported (Nature 16142, published online 9 Dec. 2015) have shown that the suppression of HR can be lifted and gene targeting successfully concluded in both kidney (293T) and osteosarcoma (U2OS) cells. Tumor suppressors, BRCA1, PALB2 and BRAC2 are known to promote DNA DSB repair by HR. They found that formation of a complex of BRCA1 with PALB2-BRAC2 is governed by a ubiquitin site on PALB2, such that action on the site by an E3 ubiquitin ligase. This E3 ubiquitin ligase is composed of KEAP1 (a PALB2-interacting protein) in complex with cullin-3 (CUL3)-RBX1. PALB2 ubiquitylation suppresses its interaction with BRCA1 and is counteracted by the deubiquitylase USP11, which is itself under cell cycle control. Restoration of the BRCA1-PALB2 interaction combined with the activation of DNA-end resection is sufficient to induce homologous recombination in G1, as measured by a number of methods including a CRISPR-Cas9-based gene-targeting assay directed at USP11 or KEAP1 (expressed from a pX459 vector). However, when the BRCA1-PALB2 interaction was restored in resection-competent G1 cells using either KEAP1 depletion or expression of the PALB2-KR mutant, a robust increase in gene-targeting events was detected.

Thus, reactivation of HR in cells, especially non-dividing, fully differentiated cell types is preferred, in some embodiments. In some embodiments, promotion of the BRCA1-PALB2 interaction is preferred in some embodiments. In some embodiments, the target ell is a non-dividing cell. In some embodiments, the target cell is a neuron or muscle cell. In some embodiments, the target cell is targeted in vivo. In some embodiments, the cell is in G1 and HR is suppressed. In some embodiments, use of KEAP1 depletion, for example inhibition of expression of KEAP1 activity, is preferred. KEAP1 depletion may be achieved through siRNA, for example as shown in Orthwein et al. Alternatively, expression of the PALB2-KR mutant (lacking all eight Lys residues in the BRCA1-interaction domain is preferred, either in combination with KEAP1 depletion or alone. PALB2-KR interacts with BRCA1 irrespective of cell cycle position. Thus, promotion or restoration of the BRCA1-PALB2 interaction, especially in G1 cells, is preferred in some embodiments, especially where the target cells are non-dividing, or where removal and return (ex vivo gene targeting) is problematic, for example neuron or muscle cells. KEAP1 siRNA is available from ThermoFischer. In some embodiments, a BRCA1-PALB2 complex may be delivered to the G1 cell. In some embodiments, PALB2 deubiquitylation may be promoted for example by increased expression of the deubiquitylase USP11, so it is envisaged that a construct may be provided to promote or up-regulate expression or activity of the deubiquitylase USP11.

Treating Diseases of the Eye

The present invention also contemplates delivering the system to one or both eyes.

In particular embodiments of the invention, the system may be used to correct ocular defects that arise from several genetic mutations further described in Genetic Diseases of the Eye, Second Edition, edited by Elias I. Traboulsi, Oxford University Press, 2012.

In some embodiments, the condition to be treated or targeted is an eye disorder. In some embodiments, the eye disorder may include glaucoma. In some embodiments, the eye disorder includes a retinal degenerative disease. In some embodiments, the retinal degenerative disease is selected from Stargardt disease, Bardet-Biedl Syndrome, Best disease, Blue Cone Monochromacy, Choroidermia, Cone-rod dystrophy, Congenital Stationary Night Blindness, Enhanced S-Cone Syndrome, Juvenile X-Linked Retinoschisis, Leber Congenital Amaurosis, Malattia Leventinesse, Norrie Disease or X-linked Familial Exudative Vitreoretinopathy, Pattern Dystrophy, Sorsby Dystrophy, Usher Syndrome, Retinitis Pigmentosa, Achromatopsia or Macular dystrophies or degeneration, Retinitis Pigmentosa, Achromatopsia, and age related macular degeneration. In some embodiments, the retinal degenerative disease is Leber Congenital Amaurosis (LCA) or Retinitis Pigmentosa. In some embodiments, the system is delivered to the eye, optionally via intravitreal injection or subretinal injection.

For administration to the eye, lentiviral vectors, in particular equine infectious anemia viruses (EIAV) are particularly preferred.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285, Published online 21 Nov. 2005 in Wiley InterScience (www.interscience.wiley.com). DOI: 10.1002/jgm.845). The vectors are contemplated to have cytomegalovirus (CMV) promoter driving expression of the target gene. Intracameral, subretinal, intraocular and intravitreal injections are all contemplated (see, e.g., Balagaan, J Gene Med 2006; 8: 275-285, Published online 21 Nov. 2005 in Wiley InterScience (www.interscience.wiley.com). DOI: 10.1002/jgm.845). Intraocular injections may be performed with the aid of an operating microscope. For subretinal and intravitreal injections, eyes may be prolapsed by gentle digital pressure and fundi visualized using a contact lens system consisting of a drop of a coupling medium solution on the cornea covered with a glass microscope slide coverslip. For subretinal injections, the tip of a 10-mm 34-gauge needle, mounted on a 5-µl Hamilton syringe may be advanced under direct visualization through the superior equatorial sclera tangentially towards the posterior pole until the aperture of the needle was visible in the subretinal space. Then, 2 µl of vector suspension may be injected to produce a superior bullous retinal detachment, thus confirming subretinal vector administration. This approach creates a self-sealing sclerotomy allowing the vector suspension to be retained in the subretinal space until it is absorbed by the RPE, usually within 48 h of the procedure. This procedure may be repeated in the inferior hemisphere to produce an inferior retinal detachment. This technique results in the exposure of approximately 70% of neurosensory retina and RPE to the vector suspension. For intravitreal injections, the needle tip may be advanced through the sclera 1 mm posterior to the corneoscleral limbus and 2 µl of vector suspension injected into the vitreous cavity. For intracameral injections, the needle tip may be advanced through a corneoscleral limbal paracentesis, directed towards the central cornea, and 2 µl of vector suspension may be injected. For intracameral injections, the needle tip may be advanced through a corneoscleral limbal paracentesis, directed towards the central cornea, and 2 µl of vector suspension may be injected. These vectors may be injected at titres of either $1.0\text{-}1.4\times10^{10}$ or $1.0\text{-}1.4\times10^{9}$ transducing units (TU)/ml.

In another embodiment, RetinoStat®, an equine infectious anemia virus-based lentiviral gene therapy vector that expresses angiostatic proteins endostain and angiostatin that is delivered via a subretinal injection for the treatment of the web form of age-related macular degeneration is also contemplated (see, e.g., Binley et al., HUMAN GENE THERAPY 23:980-991 (September 2012)). Such a vector may be modified for the system of the present invention. Each eye may be treated with either RetinoStat® at a dose of $1.1\times105$ transducing units per eye (TU/eye) in a total volume of 100 µl.

In another embodiment, an E1-, partial E3-, E4-deleted adenoviral vector may be contemplated for delivery to the eye. Twenty-eight patients with advanced neovascular age-related macular degeneration (AMD) were given a single intravitreous injection of an E1-, partial E3-, E4-deleted adenoviral vector expressing human pigment epithelium-derived factor (AdPEDF.11) (see, e.g., Campochiaro et al., Human Gene Therapy 17:167-176 (February 2006)). Doses ranging from 106 to 109.5 particle units (PU) were investigated and there were no serious adverse events related to AdPEDF.11 and no dose-limiting toxicities (see, e.g., Campochiaro et al., Human Gene Therapy 17:167-176 (February 2006)). Adenoviral vectormediated ocular gene transfer appears to be a viable approach for the treatment of ocular disorders and could be applied to the system.

In another embodiment, the sd-rxRNA® system of Rxi Pharmaceuticals may be used/and or adapted for delivering the systems to the eye. In this system, a single intravitreal administration of 3 µg of sd-rxRNA results in sequence-specific reduction of PPIB mRNA levels for 14 days. The sd-rxRNA® system may be applied to the nucleic acid-targeting system of the present invention, contemplating a dose of about 3 to 20 mg of CRISPR administered to a human.

Millington-Ward et al. (Molecular Therapy, vol. 19 no. 4, 642-649 April 2011) describes adeno-associated virus (AAV) vectors to deliver an RNA interference (RNAi)-based rhodopsin suppressor and a codon-modified rhodopsin replacement gene resistant to suppression due to nucleotide alterations at degenerate positions over the RNAi target site. An injection of either $6.0\times10^{8}$ vp or $1.8\times10^{10}$ vp AAV were subretinally injected into the eyes by Millington-Ward et al. The AAV vectors of Millington-Ward et al. may be applied to the system of the present invention, contemplating a dose of about $2\times10^{11}$ to about $6\times10^{13}$ vp administered to a human.

Dalkara et al. (Sci Transl Med 5, 189ra76 (2013)) also relates to in vivo directed evolution to fashion an AAV vector that delivers wild-type versions of defective genes throughout the retina after noninjurious injection into the eyes' vitreous humor. Dalkara describes a 7mer peptide display library and an AAV library constructed by DNA shuffling of cap genes from AAV1, 2, 4, 5, 6, 8, and 9. The rcAAV libraries and rAAV vectors expressing GFP under a CAG or Rho promoter were packaged and deoxyribonuclease-resistant genomic titers were obtained through quantitative PCR. The libraries were pooled, and two rounds of evolution were performed, each consisting of initial library diversification followed by three in vivo selection steps. In each such step, P30 rho-GFP mice were intravitreally injected with 2 ml of iodixanol-purified, phosphate-buffered saline (PBS)—dialyzed library with a genomic titer of about $1\times10^{12}$ vg/ml. The AAV vectors of Dalkara et al. may be applied to the nucleic acid-targeting system of the present invention, contemplating a dose of about $1\times10^{15}$ to about $1\times10^{16}$ vg/ml administered to a human.

In a particular embodiment, the rhodopsin gene may be targeted for the treatment of retinitis pigmentosa (RP), wherein the system of US Patent Publication No. 20120204282 assigned to Sangamo BioSciences, Inc. may be modified in accordance of the system of the present invention.

In another embodiment, the methods of US Patent Publication No. 20130183282 assigned to Cellectis, which is directed to methods of cleaving a target sequence from the human rhodopsin gene, may also be modified to the nucleic acid-targeting system of the present invention.

US Patent Publication No. 20130202678 assigned to Academia *Sinica* relates to methods for treating retinopathies and sight-threatening ophthalmologic disorders relating to delivering of the Puf-A gene (which is expressed in retinal ganglion and pigmented cells of eye tissues and displays a unique anti-apoptotic activity) to the sub-retinal or intravitreal space in the eye. In particular, desirable targets are zgc:193933, prdmla, spata2, tex10, rbb4, ddx3, zp2.2, Blimp-1 and HtrA2, all of which may be targeted by the nucleic acid-targeting system of the present invention.

Wu (Cell Stem Cell,13:659-62, 2013) designed a guide RNA that led Cas9 to a single base pair mutation that causes cataracts in mice, where it induced DNA cleavage. Then using either the other wild-type allele or oligos given to the zygotes repair mechanisms corrected the sequence of the broken allele and corrected the cataract-causing genetic defect in mutant mouse.

US Patent Publication No. 20120159653, describes use of zinc finger nucleases to genetically modify cells, animals and proteins associated with macular degeration (MD). Macular degeneration (MD) is the primary cause of visual impairment in the elderly, but is also a hallmark symptom of childhood diseases such as Stargardt disease, Sorsby fundus, and fatal childhood neurodegenerative diseases, with an age of onset as young as infancy. Macular degeneration results in a loss of vision in the center of the visual field (the macula) because of damage to the retina. Currently existing animal models do not recapitulate major hallmarks of the disease as it is observed in humans. The available animal models comprising mutant genes encoding proteins associated with MD also produce highly variable phenotypes, making translations to human disease and therapy development problematic.

One aspect of US Patent Publication No. 20120159653 relates to editing of any chromosomal sequences that encode proteins associated with MD which may be applied to the nucleic acid-targeting system of the present invention. The proteins associated with MD are typically selected based on an experimental association of the protein associated with MD to an MD disorder. For example, the production rate or circulating concentration of a protein associated with MD may be elevated or depressed in a population having an MD disorder relative to a population lacking the MD disorder. Differences in protein levels may be assessed using proteomic techniques including but not limited to Western blot, immunohistochemical staining, enzyme linked immunosorbent assay (ELISA), and mass spectrometry. Alternatively, the proteins associated with MD may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with MD include but are not limited to the following proteins: (ABCA4) ATP-binding cassette, sub-family A (ABC1), member 4 ACHM1 achromatopsia (rod monochromacy) 1 ApoE Apolipoprotein E (ApoE) C1QTNF5 (CTRP5) C1q and tumor necrosis factor related protein 5 (C1QTNF5) C2 Complement component 2 (C2) C3 Complement components (C3) CCL2 Chemokine (C—C motif) Ligand 2 (CCL2) CCR2 Chemokine (C—C motif) receptor 2 (CCR2) CD36 Cluster of Differentiation 36 CFB Complement factor B CFH Complement factor CFH H CFHR1 complement factor H-related 1 CFHR3 complement factor H-related 3 CNGB3 cyclic nucleotide gated channel beta 3 CP ceruloplasmin (CP) CRP C reactive protein (CRP) CST3 cystatin C or cystatin 3 (CST3) CTSD Cathepsin D (CTSD) CX3CR1 chemokine (C-X3-C motif) receptor 1 ELOVL4 Elongation of very long chain fatty acids 4 ERCC6 excision repair crosscomplementing rodent repair deficiency, complementation group 6 FBLNS Fibulin-5 FBLNS Fibulin 5 FBLN6 Fibulin 6 FSCN2 fascin (FSCN2) HMCN1 Hemicentrin 1 HMCN1 hemicentrin 1 HTRA1 HtrA serine peptidase 1 (HTRA1) HTRA1 HtrA serine peptidase 1 IL-6 Interleukin 6 IL-8 Interleukin 8 LOC387715 Hypothetical protein PLEKHA1 Pleckstrin homology domain containing family A member 1 (PLEKHA1) PROM1 Prominin 1(PROM1 or CD133) PRPH2 Peripherin-2 RPGR retinitis pigmentosa GTPase regulator SERPING1 serpin peptidase inhibitor, clade G, member 1 (C1-inhibitor) TCOF1 Treacle TIMP3 Metalloproteinase inhibitor 3 (TIMP3) TLR3 Toll-like receptor 3.

The identity of the protein associated with MD whose chromosomal sequence is edited can and will vary. In preferred embodiments, the proteins associated with MD whose chromosomal sequence is edited may be the ATP-binding cassette, sub-family A (ABC1) member 4 protein (ABCA4) encoded by the ABCR gene, the apolipoprotein E protein (APOE) encoded by the APOE gene, the chemokine (C—C motif) Ligand 2 protein (CCL2) encoded by the CCL2 gene, the chemokine (C—C motif) receptor 2 protein (CCR2) encoded by the CCR2 gene, the ceruloplasmin protein (CP) encoded by the CP gene, the cathepsin D protein (CTSD) encoded by the CTSD gene, or the metalloproteinase inhibitor 3 protein (TIMP3) encoded by the TIMP3 gene. In an exemplary embodiment, the genetically modified animal is a rat, and the edited chromosomal sequence encoding the protein associated with MD may be: (ABCA4) ATPbinding cassette, NM_000350 sub-family A (ABC1), member 4 APOE Apolipoprotein E NM_138828 (APOE) CCL2 Chemokine (C—C NM_031530 motif) Ligand 2 (CCL2) CCR2 Chemokine (C—C NM_021866 motif) receptor 2 (CCR2) CP ceruloplasmin (CP) NM_012532 CTSD Cathepsin D (CTSD) NM_134334 TIMP3 Metalloproteinase NM_012886 inhibitor 3 (TIMP3) The animal or cell may comprise 1, 2, 3, 4, 5, 6, 7 or more disrupted chromosomal sequences encoding a protein associated with MD and zero, 1, 2, 3, 4, 5, 6, 7 or more chromosomally integrated sequences encoding the disrupted protein associated with MD.

The edited or integrated chromosomal sequence may be modified to encode an altered protein associated with MD. Several mutations in MD-related chromosomal sequences have been associated with MD. Non-limiting examples of mutations in chromosomal sequences associated with MD include those that may cause MD including in the ABCR protein, E471K (i.e. glutamate at position 471 is changed to lysine), R1129L (i.e. arginine at position 1129 is changed to leucine), T1428M (i.e. threonine at position 1428 is changed to methionine), R15175 (i.e. arginine at position 1517 is changed to serine), I1562T (i.e. isoleucine at position 1562 is changed to threonine), and G1578R (i.e. glycine at position 1578 is changed to arginine); in the CCR2 protein, V64I (i.e. valine at position 192 is changed to isoleucine); in CP protein, G969B (i.e. glycine at position 969 is changed to asparagine or aspartate); in TIMP3 protein, S156C (i.e. serine at position 156 is changed to cysteine), G166C (i.e. glycine at position 166 is changed to cysteine), G167C (i.e. glycine at position 167 is changed to cysteine), Y168C (i.e. tyrosine at position 168 is changed to cysteine), 5170C (i.e. serine at position 170 is changed to cysteine), Y172C (i.e. tyrosine at position 172 is changed to cysteine) and S181C (i.e. serine at position 181 is changed to cysteine). Other associations of genetic variants in MD-associated genes and disease are known in the art.

The systems are useful to correct diseases resulting from autosomal dominant genes. For example, CRISPR/Cas9 was used to remove an autosomal dominant gene that causes receptor loss in the eye. Bakondi, B. et al., In Vivo CRISPR/Cas9 Gene Editing Corrects Retinal Dystrophy in the S334ter-3 Rat Model of Autosomal Dominant Retinitis Pigmentosa. Molecular Therapy, 2015; DOI: 10.1038/mt.2015.220.

Treating Circulatory and Muscular Diseases

The present invention also contemplates delivering the system described herein, e.g. to the heart. For the heart, a myocardium tropic adena-associated virus (AAVM) is preferred, in particular AAVM41 which showed preferential gene transfer in the heart (see, e.g., Lin-Yanga et al., PNAS, Mar. 10, 2009, vol. 106, no. 10). Administration may be systemic or local. A dosage of about $1-10 \times 10^{14}$ vector genomes are contemplated for systemic administration. See also, e.g., Eulalio et al. (2012) Nature 492: 376 and Somasuntharam et al. (2013) Biomaterials 34: 7790.

For example, US Patent Publication No. 20110023139, describes use of zinc finger nucleases to genetically modify cells, animals and proteins associated with cardiovascular disease. Cardiovascular diseases generally include high blood pressure, heart attacks, heart failure, and stroke and TIA. Any chromosomal sequence involved in cardiovascular disease or the protein encoded by any chromosomal sequence involved in cardiovascular disease may be utilized in the methods described in this disclosure. The cardiovascular-related proteins are typically selected based on an experimental association of the cardiovascular-related protein to the development of cardiovascular disease. For example, the production rate or circulating concentration of a cardiovascular-related protein may be elevated or depressed in a population having a cardiovascular disorder relative to a population lacking the cardiovascular disorder. Differences in protein levels may be assessed using proteomic techniques including but not limited to Western blot, immunohistochemical staining, enzyme linked immunosorbent assay (ELISA), and mass spectrometry. Alternatively, the cardiovascular-related proteins may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of example, the chromosomal sequence may comprise, but is not limited to, IL1B (interleukin 1, beta), XDH (xanthine dehydrogenase), TP53 (tumor protein p53), PTGIS (prostaglandin I2 (prostacyclin) synthase), MB (myoglobin), IL4 (interleukin 4), ANGPT1 (angiopoietin 1), ABCG8 (ATP-binding cassette, sub-family G (WHITE), member 8), CTSK (cathepsin K), PTGIR (prostaglandin I2 (prostacyclin) receptor (IP)), KCNJ11 (potassium inwardly-rectifying channel, subfamily J, member 11), INS (insulin), CRP (C-reactive protein, pentraxin-related), PDGFRB (platelet-derived growth factor receptor, beta polypeptide), CCNA2 (cyclin A2), PDGFB (platelet-derived growth factor beta polypeptide (simian sarcoma viral (v-sis) oncogene homolog)), KCNJ5 (potassium inwardly-rectifying channel, subfamily J, member 5), KCNN3 (potassium intermediate/small conductance calcium-activated channel, subfamily N, member 3), CAPN10 (calpain 10), PTGES (prostaglandin E synthase), ADRA2B (adrenergic, alpha-2B-, receptor), ABCG5 (ATP-binding cassette, sub-family G (WHITE), member 5), PRDX2 (peroxiredoxin 2), CAPNS (calpain 5), PARP14 (poly (ADP-ribose) polymerase family, member 14), MEX3C (mex-3 homolog C (C. elegans)), ACE angiotensin I converting enzyme (peptidyl-dipeptidase A) 1), TNF (tumor necrosis factor (TNF superfamily, member 2)), IL6 (interleukin 6 (interferon, beta 2)), STN (statin), SERPINE1 (serpin peptidase inhibitor, clade E (nexin, plasminogen activator inhibitor type 1), member 1), ALB (albumin), ADIPOQ (adiponectin, C1Q and collagen domain containing), APOB (apolipoprotein B (including Ag(x) antigen)), APOE (apolipoprotein E), LEP (leptin), MTHFR (5,10-methylenetetrahydrofolate reductase (NADPH)), APOA1 (apolipoprotein A-I), EDN1 (endothelin 1), NPPB (natriuretic peptide precursor B), NOS3 (nitric oxide synthase 3 (endothelial cell)), PPARG (peroxisome proliferator-activated receptor gamma), PLAT (plasminogen activator, tissue), PTGS2 (prostaglandin-endoperoxide synthase 2 (prostaglandin G/H synthase and cyclooxygenase)), CETP (cholesteryl ester transfer protein, plasma), AGTR1 (angiotensin II receptor, type 1), HMGCR (3-hydroxy-3-methylglutaryl-Coenzyme A reductase), IGF1 (insulin-like growth factor 1 (somatomedin C)), SELE (selectin E), REN (renin), PPARA (peroxisome proliferator-activated receptor alpha), PON1 (paraoxonase 1), KNG1 (kininogen 1), CCL2 (chemokine (C—C motif) ligand 2), LPL (lipoprotein lipase), VWF (von Willebrand factor), F2 (coagulation factor II (thrombin)), ICAM1 (intercellular adhesion molecule 1), TGFB1 (transforming growth factor, beta 1), NPPA (natriuretic peptide precursor A), IL10 (interleukin 10), EPO (erythropoietin), SOD1 (superoxide dismutase 1, soluble), VCAM1 (vascular cell adhesion molecule 1), IFNG (interferon, gamma), LPA (lipoprotein, Lp(a)), MPO (myeloperoxidase), ESR1 (estrogen receptor 1), MAPK1 (mitogen-activated protein kinase 1), HP (haptoglobin), F3 (coagulation factor III (thromboplastin, tissue factor)), CST3 (cystatin C), COG2 (component of oligomeric golgi complex 2), MMP9 (matrix metallopeptidase 9 (gelatinase B, 92 kDa gelatinase, 92 kDa type IV collagenase)), SERPINC1 (serpin peptidase inhibitor, clade C (antithrombin), member 1), F8 (coagulation factor VIII, procoagulant component), HMOX1 (heme oxygenase (decycling) 1), APOC3 (apolipoprotein C-III), IL8 (interleukin 8), PROK1 (prokineticin 1), CBS (cystathionine-beta-synthase), NOS2 (nitric oxide synthase 2, inducible), TLR4 (toll-like receptor 4), SELP (selectin P (granule membrane protein 140 kDa, antigen CD62)), ABCA1 (ATP-binding cassette, sub-family A (ABC1), member 1), AGT (angiotensinogen (serpin peptidase inhibitor, clade A, member 8)), LDLR (low density lipoprotein receptor), GPT (glutamic-pyruvate transaminase (alanine aminotransferase)), VEGFA (vascular endothelial growth factor A), NR3C2 (nuclear receptor subfamily 3, group C, member 2), IL18 (interleukin 18 (interferon-gamma-inducing factor)), NOS1 (nitric oxide synthase 1 (neuronal)), NR3C1 (nuclear receptor subfamily 3, group C, member 1 (glucocorticoid receptor)), FGB (fibrinogen beta chain), HGF (hepatocyte growth factor (hepapoietin A; scatter factor)), IL1A (interleukin 1, alpha), RETN (resistin), AKT1 (v-akt murine thymoma viral oncogene homolog 1), LIPC (lipase, hepatic), HSPD1 (heat shock 60 kDa protein 1 (chaperonin)), MAPK14 (mitogen-activated protein kinase 14), SPP1 (secreted phosphoprotein 1), ITGB3 (integrin, beta 3 (platelet glycoprotein IIIa, antigen CD61)), CAT (catalase), UTS2 (urotensin 2), THBD (thrombomodulin), F10 (coagulation factor X), CP (ceruloplasmin (ferroxidase)), TNFRSF11B (tumor necrosis factor receptor superfamily, member 11b), EDNRA (endothelin receptor type A), EGFR (epidermal growth factor receptor (erythroblastic leukemia viral (v-erb-b) oncogene homolog, avian)), MMP2 (matrix metallopeptidase 2 (gelatinase A, 72 kDa gelatinase, 72 kDa type IV collagenase)), PLG (plasminogen), NPY (neuropeptide Y), RHOD (ras homolog gene family, member D), MAPK8 (mitogen-activated protein kinase 8), MYC (v-myc myelocytomatosis viral oncogene homolog (avian)), FN1 (fibronectin 1), CMA1 (chymase 1, mast cell), PLAU (plasminogen activator, urokinase), GNB3 (guanine nucleotide binding protein (G protein), beta polypeptide 3), ADRB2 (adrenergic, beta-2-, receptor, surface), APOA5 (apolipoprotein A-V), SOD2 (superoxide dismutase 2, mitochondrial), F5 (coagulation factor V (proaccelerin, labile factor)), VDR (vitamin D (1,25-dihydroxyvitamin D3) receptor), ALOX5 (arachidonate 5-lipoxygenase), HLA-DRB1 (major histocompatibility complex, class II, DR beta 1), PARP1 (poly (ADP-ribose) polymerase 1), CD40LG (CD40 ligand), PON2 (paraoxonase 2), AGER (advanced glycosylation end product-specific receptor), IRS1 (insulin receptor substrate 1), PTGS1 (prostaglandin-endoperoxide synthase 1 (prostaglandin G/H synthase and cyclooxygenase)), ECE1 (endothelin converting enzyme 1), F7 (coagulation factor VII (serum prothrombin conversion accelerator)), URN (interleukin 1 receptor antagonist), EPHX2 (epoxide hydrolase 2, cytoplasmic), IGFBP1 (insulin-like growth factor binding protein 1), MAPK10 (mitogen-activated protein kinase 10), FAS (Fas (TNF receptor superfamily, member 6)), ABCB1 (ATP-binding cassette, sub-family B (MDR/TAP), member 1), JUN (jun oncogene), IGFBP3 (insulin-like growth factor binding protein 3), CD14 (CD14 molecule), PDE5A (phosphodiesterase 5A, cGMP-specific), AGTR2 (angiotensin II receptor, type 2), CD40 (CD40 molecule, TNF receptor superfamily member 5), LCAT (lecithin-cholesterol acyltransferase), CCR5 (chemokine (C—C motif) receptor 5), MMP1 (matrix metallopeptidase 1 (interstitial collagenase)), TIMP1 (TIMP metallopeptidase inhibitor 1), ADM (adrenomedullin), DYT10 (dystonia 10), STAT3 (signal transducer and activator of transcription 3 (acute-phase response factor)), MMP3 (matrix metallopeptidase 3 (stromelysin 1, progelatinase)), ELN (elastin), USF1 (upstream transcription factor 1), CFH (complement factor H), HSPA4 (heat shock 70 kDa protein 4), MMP12 (matrix metallopeptidase 12 (macrophage elastase)), MME (membrane metallo-endopeptidase), F2R (coagulation factor II (thrombin) receptor), SELL (selectin L), CTSB (cathepsin B), ANXA5 (annexin A5), ADRB1 (adrenergic, beta-1-, receptor), CYBA (cytochrome b-245, alpha polypeptide), FGA (fibrinogen alpha chain), GGT1 (gamma-glutamyltransferase 1), LIPG (lipase, endothelial), HIF1A (hypoxia inducible factor 1, alpha subunit (basic helix-loop-helix transcription factor)), CXCR4 (chemokine (C—X—C motif) receptor 4), PROC (protein C (inactivator of coagulation factors Va and VIIIa)), SCARB1 (scavenger receptor class B, member 1), CD79A (CD79a molecule, immunoglobulin-associated alpha), PLTP (phospholipid transfer protein), ADD1 (adducin 1 (alpha)), FGG (fibrinogen gamma chain), SAA1 (serum amyloid A1), KCNH2 (potassium voltage-gated channel, subfamily H (eag-related), member 2), DPP4 (dipeptidyl-peptidase 4), G6PD (glucose-6-phosphate dehydrogenase), NPR1 (natriuretic peptide receptor A/guanylate cyclase A (atrionatriuretic peptide receptor A)), VTN (vitronectin), KIAA0101 (KIAA0101), FOS (FBJ murine osteosarcoma viral oncogene homolog), TLR2 (toll-like receptor 2), PPIG (peptidylprolyl isomerase G (cyclophilin G)), IL1R1 (interleukin 1 receptor, type I), AR (androgen receptor), CYP1A1 (cytochrome P450, family 1, subfamily A, polypeptide 1), SERPINA1 (serpin peptidase inhibitor, clade A (alpha-1 antiproteinase, antitrypsin), member 1), MTR (5-methyltetrahydrofolate-homocysteine methyltransferase), RBP4 (retinol binding protein 4, plasma), APOA4 (apolipoprotein A-IV), CDKN2A (cyclin-dependent kinase inhibitor 2A (melanoma, p16, inhibits CDK4)), FGF2 (fibroblast growth factor 2 (basic)), EDNRB (endothelin receptor type B), ITGA2 (integrin, alpha 2 (CD49B, alpha 2 subunit of VLA-2 receptor)), CABIN1 (calcineurin binding protein 1), SHBG (sex hormone-binding globulin), HMGB1 (high-mobility group box 1), HSP90B2P (heat shock protein 90 kDa beta (Grp94), member 2 (pseudogene)), CYP3A4 (cytochrome P450, family 3, subfamily A, polypeptide 4), GJA1 (gap junction protein, alpha 1, 43 kDa), CAV1 (caveolin 1, caveolae protein, 22 kDa), ESR2 (estrogen receptor 2 (ER beta)), LTA (lymphotoxin alpha (TNF superfamily, member 1)), GDF15 (growth differentiation factor 15), BDNF (brain-derived neurotrophic factor), CYP2D6 (cytochrome P450, family 2, subfamily D, polypeptide 6), NGF (nerve growth factor (beta polypeptide)), SP1 (Sp1 transcription factor), TGIF1 (TGFB-induced factor homeobox 1), SRC (v-src sarcoma (Schmidt-Ruppin A-2) viral oncogene homolog (avian)), EGF (epidermal growth factor (beta-urogastrone)), PIK3CG (phosphoinositide-3-kinase, catalytic, gamma polypeptide), HLA-A (major histocompatibility complex, class I, A), KCNQ1 (potassium voltage-gated channel, KQT-like subfamily, member 1), CNR1 (cannabinoid receptor 1 (brain)), FBN1 (fibrillin 1), CHKA (choline kinase alpha), BEST1 (bestrophin 1), APP (amyloid beta (A4) precursor protein), CTNNB1 (catenin (cadherin-associated protein), beta 1, 88 kDa), IL2 (interleukin 2), CD36 (CD36 molecule (thrombospondin receptor)), PRKAB1 (protein kinase, AMP-activated, beta 1 non-catalytic subunit), TPO (thyroid peroxidase), ALDH7A1 (aldehyde dehydrogenase 7 family, member A1), CX3CR1 (chemokine (C-X3-C motif) receptor 1), TH (tyrosine hydroxylase), F9 (coagulation factor IX), GH1 (growth hormone 1), TF (transferrin), HFE (hemochromatosis), IL17A (interleukin 17A), PTEN (phosphatase and tensin homolog), GSTM1 (glutathione S-transferase mu 1), DMD (dystrophin), GATA4 (GATA binding protein 4), F13A1 (coagulation factor XIII, A1 polypeptide), TTR (transthyretin), FABP4 (fatty acid binding protein 4, adipocyte), PON3 (paraoxonase 3), APOC1 (apolipoprotein C-I), INSR (insulin receptor), TNFRSF1B (tumor necrosis factor receptor superfamily, member 1B), HTR2A (5-hydroxytryptamine (serotonin) receptor 2A), CSF3 (colony stimulating factor 3 (granulocyte)), CYP2C9 (cytochrome P450, family 2, subfamily C, polypeptide 9), TXN (thioredoxin), CYP11B2 (cytochrome P450, family 11, subfamily B, polypeptide 2), PTH (parathyroid hormone), CSF2 (colony stimulating factor 2 (granulocyte-macrophage)), KDR (kinase insert domain receptor (a type III receptor tyrosine kinase)), PLA2G2A (phospholipase A2, group IIA (platelets, synovial fluid)), B2M (beta-2-microglobulin), THBS1 (thrombospondin 1), GCG (glucagon), RHOA (ras homolog gene family, member A), ALDH2 (aldehyde dehydrogenase 2 family (mitochondrial)), TCF7L2 (transcription factor 7-like 2 (T-cell specific, HMG-box)), BDKRB2 (bradykinin receptor B2), NFE2L2 (nuclear factor (erythroid-derived 2)-like 2), NOTCH1 (Notch homolog 1, translocation-associated (*Drosophila*)), UGT1A1 (UDP glucuronosyltransferase 1 family, polypeptide A1), IFNA1 (interferon, alpha 1), PPARD (peroxisome proliferator-activated receptor delta), SIRT1 (sirtuin (silent mating type information regulation 2 homolog) 1 (*S. cerevisiae*)), GNRH1 (gonadotropin-releasing hormone 1 (luteinizing-releasing hormone)), PAPPA (pregnancy-associated plasma protein A, pappalysin 1), ARR3 (arrestin 3, retinal (X-arrestin)), NPPC (natriuretic peptide precursor C), AHSP (alpha hemoglobin stabilizing protein), PTK2 (PTK2 protein tyrosine kinase 2), IL13 (interleukin 13), MTOR (mechanistic target of rapamycin (serine/threonine kinase)), ITGB2 (integrin, beta 2 (complement component 3 receptor 3 and 4 subunit)), GSTT1 (glutathione S-transferase theta 1), IL6ST (interleukin 6 signal transducer (gp130, oncostatin M receptor)), CPB2 (carboxypeptidase B2 (plasma)), CYP1A2 (cytochrome P450, family 1, subfamily A, polypeptide 2), HNF4A (hepatocyte nuclear factor 4, alpha), SLC6A4 (solute carrier family 6 (neurotransmitter transporter, serotonin), member 4), PLA2G6 (phospholipase A2, group VI (cytosolic, calcium-independent)), TNFSF11 (tumor necrosis factor (ligand) superfamily, member 11), SLC8A1 (solute carrier family 8 (sodium/calcium exchanger), member 1), F2RL1 (coagulation factor II (thrombin) receptor-like 1), AKR1A1 (aldo-keto reductase family 1, member A1 (aldehyde reductase)), ALDH9A1 (aldehyde dehydrogenase 9 family, member A1), BGLAP (bone gamma-carboxyglutamate (gla) protein), MTTP (microsomal triglyceride transfer protein), MTRR (5-methyltetrahydrofolate-homocysteine methyltransferase reductase), SULT1A3 (sulfotransferase family, cytosolic, 1A, phenol-preferring, member 3), RAGE (renal tumor antigen), C4B (complement component 4B (Chido blood group), P2RY12 (purinergic receptor P2Y, G-protein coupled, 12), RNLS (renalase, FAD-dependent amine oxidase), CREB1 (cAMP responsive element binding protein 1), POMC (proopiomelanocortin), RAC1 (ras-related C3 botulinum toxin substrate 1 (rho family, small GTP binding protein Rac1)), LMNA (lamin NC), CD59 (CD59 molecule, complement regulatory protein), SCN5A (sodium channel, voltage-gated, type V, alpha subunit), CYP1B1 (cytochrome P450, family 1, subfamily B, polypeptide 1), MIF (macrophage migration inhibitory factor (glycosylation-inhibiting factor)), MMP13 (matrix metallopeptidase 13 (collagenase 3)), TIMP2 (TIMP metallopeptidase inhibitor 2), CYP19A1 (cytochrome P450, family 19, subfamily A, polypeptide 1), CYP21A2 (cytochrome P450, family 21, subfamily A, polypeptide 2), PTPN22 (protein tyrosine phosphatase, non-receptor type 22 (lymphoid)), MYH14 (myosin, heavy chain 14, non-muscle), MBL2 (mannose-binding lectin (protein C) 2, soluble (opsonic defect)), SELPLG (selectin P ligand), AOC3 (amine oxidase, copper containing 3 (vascular adhesion protein 1)), CTSL1 (cathepsin L1), PCNA (proliferating cell nuclear antigen), IGF2 (insulin-like growth factor 2 (somatomedin A)), ITGB1 (integrin, beta 1 (fibronectin receptor, beta polypeptide, antigen CD29 includes MDF2, MSK12)), CAST (calpastatin), CXCL12 (chemokine (C—X—C motif) ligand 12 (stromal cell-derived factor 1)), IGHE (immunoglobulin heavy constant epsilon), KCNE1 (potassium voltage-gated channel, Isk-related family, member 1), TFRC (transferrin receptor (p90, CD71)), COL1A1 (collagen, type I, alpha 1), COL1A2 (collagen, type I, alpha 2), IL2RB (interleukin 2 receptor, beta), PLA2G10 (phospholipase A2, group X), ANGPT2 (angiopoietin 2), PROCR (protein C receptor, endothelial (EPCR)), NOX4 (NADPH oxidase 4), HAMP (hepcidin antimicrobial peptide), PTPN11 (protein tyrosine phosphatase, non-receptor type 11), SLC2A1 (solute carrier family 2 (facilitated glucose transporter), member 1), IL2RA (interleukin 2 receptor, alpha), CCL5 (chemokine (C—C motif) ligand 5), IRF1 (interferon regulatory factor 1), CFLAR (CASP8 and FADD-like apoptosis regulator), CALCA (calcitonin-related polypeptide alpha), EIF4E (eukaryotic translation initiation factor 4E), GSTP1 (glutathione S-transferase pi 1), JAK2 (Janus kinase 2), CYP3A5 (cytochrome P450, family 3, subfamily A, polypeptide 5), HSPG2 (heparan sulfate proteoglycan 2), CCL3 (chemokine (C—C motif) ligand 3), MYD88 (myeloid differentiation primary response gene (88)), VIP (vasoactive intestinal peptide), SOAT1 (sterol O-acyltransferase 1), ADRBK1 (adrenergic, beta, receptor kinase 1), NR4A2 (nuclear receptor subfamily 4, group A, member 2), MMP8 (matrix metallopeptidase 8 (neutrophil collagenase)), NPR2 (natriuretic peptide receptor B/guanylate cyclase B (atrionatriuretic peptide receptor B)), GCH1 (GTP cyclohydrolase 1), EPRS (glutamyl-prolyl-tRNA synthetase), PPARGC1A (peroxisome proliferator-activated receptor gamma, coactivator 1 alpha), F12 (coagulation factor XII (Hageman factor)), PECAM1 (platelet/endothelial cell adhesion molecule), CCL4 (chemokine (C—C motif) ligand 4), SERPINA3 (serpin peptidase inhibitor, clade A (alpha-1 antiproteinase, antitrypsin), member 3), CASR (calcium-sensing receptor), GJA5 (gap junction protein, alpha 5, 40 kDa), FABP2 (fatty acid binding protein 2, intestinal), TTF2 (transcription termination factor, RNA polymerase II), PROS1 (protein S (alpha)), CTF1 (cardiotrophin 1), SGCB (sarcoglycan, beta (43 kDa dystrophin-associated glycoprotein)), YME1L1 (YME1-like 1 (S. cerevisiae)), CAMP (cathelicidin antimicrobial peptide), ZC3H12A (zinc finger CCCH-type containing 12A), AKR1B1 (aldo-keto reductase family 1, member B1 (aldose reductase)), DES (desmin), MMP7 (matrix metallopeptidase 7 (matrilysin, uterine)), AHR (aryl hydrocarbon receptor), CSF1 (colony stimulating factor 1 (macrophage)), HDAC9 (histone deacetylase 9), CTGF (connective tissue growth factor), KCNMA1 (potassium large conductance calcium-activated channel, subfamily M, alpha member 1), UGT1A (UDP glucuronosyltransferase 1 family, polypeptide A complex locus), PRKCA (protein kinase C, alpha), COMT (catechol-.beta.-methyltransferase), S100B (S100 calcium binding protein B), EGR1 (early growth response 1), PRL (prolactin), IL15 (interleukin 15), DRD4 (dopamine receptor D4), CAMK2G (calcium/calmodulin-dependent protein kinase II gamma), SLC22A2 (solute carrier family 22 (organic cation transporter), member 2), CCL11 (chemokine (C—C motif) ligand 11), PGF (B321 placental growth factor), THPO (thrombopoietin), GP6 (glycoprotein VI (platelet)), TACR1 (tachykinin receptor 1), NTS (neurotensin), HNF1A (HNF1 homeobox A), SST (somatostatin), KCND1 (potassium voltage-gated channel, Shal-related subfamily, member 1), LOC646627 (phospholipase inhibitor), TBXAS1 (thromboxane A synthase 1 (platelet)), CYP2J2 (cytochrome P450, family 2, subfamily J, polypeptide 2), TBXA2R (thromboxane A2 receptor), ADH1C (alcohol dehydrogenase 1C (class I), gamma polypeptide), ALOX12 (arachidonate 12-lipoxygenase), AHSG (alpha-2-HS-glycoprotein), BHMT (betaine-homocysteine methyltransferase), GJA4 (gap junction protein, alpha 4, 37 kDa), SLC25A4 (solute carrier family 25 (mitochondrial carrier; adenine nucleotide translocator), member 4), ACLY (ATP citrate lyase), ALOX5AP (arachidonate 5-lipoxygenase-activating protein), NUMA1 (nuclear mitotic apparatus protein 1), CYP27B1 (cytochrome P450, family 27, subfamily B, polypeptide 1), CYSLTR2 (cysteinyl leukotriene receptor 2), SOD3 (superoxide dismutase 3, extracellular), LTC4S (leukotriene C4 synthase), UCN (urocortin), GHRL (ghrelin/obestatin prepropeptide), APOC2 (apolipoprotein C-II), CLEC4A (C-type lectin domain family 4, member A), KBTBD10 (kelch repeat and BTB (POZ) domain containing 10), TNC (tenascin C), TYMS (thymidylate synthetase), SHC1 (SHC (Src homology 2 domain containing) transforming protein 1), LRP1 (low density lipoprotein receptor-related protein 1), SOCS3 (suppressor of cytokine signaling 3), ADH1B (alcohol dehydrogenase 1B (class I), beta polypeptide), KLK3 (kallikrein-related peptidase 3), HSD11B1 (hydroxysteroid (11-beta) dehydrogenase 1), VKORC1 (vitamin K epoxide reductase complex, subunit 1), SERPINB2 (serpin peptidase inhibitor, clade B (ovalbumin), member 2), TNS1 (tensin 1), RNF19A (ring finger protein 19A), EPOR (erythropoietin receptor), ITGAM (integrin, alpha M (complement component 3 receptor 3 subunit)), PITX2 (paired-like homeodomain 2), MAPK7 (mitogen-activated protein kinase 7), FCGR3A (Fc fragment of IgG, low affinity 111a, receptor (CD16a)), LEPR (leptin receptor), ENG (endoglin), GPX1 (glutathione peroxidase 1), GOT2 (glutamic-oxaloacetic transaminase 2, mitochondrial (aspartate aminotransferase 2)), HRH1 (histamine receptor H1), NR1I2 (nuclear receptor subfamily 1, group I, member 2), CRH (corticotropin releasing hormone), HTR1A (5-hydroxytryptamine (serotonin) receptor 1A), VDAC1 (voltage-dependent anion channel 1), HPSE (heparanase), SFTPD (surfactant protein D), TAP2 (transporter 2, ATP-binding cassette, sub-family B (MDR/TAP)), RNF123 (ring finger protein 123), PTK2B (PTK2B protein tyrosine kinase 2 beta), NTRK2 (neurotrophic tyrosine kinase, receptor, type 2), IL6R (interleukin 6 receptor), ACHE (acetylcholinesterase (Yt blood group)), GLP1R (glucagon-like peptide 1 receptor), GHR (growth hormone receptor), GSR (glutathione reductase), NQO1 (NAD(P)H dehydrogenase, quinone 1), NR5A1 (nuclear receptor subfamily 5, group A, member 1), GJB2 (gap junction protein, beta 2, 26 kDa), SLC9A1 (solute carrier family 9 (sodium/hydrogen exchanger), member 1), MAOA (monoamine oxidase A), PCSK9 (proprotein convertase subtilisin/kexin type 9), FCGR2A (Fc fragment of IgG, low affinity IIa, receptor (CD32)), SERPINF1 (serpin peptidase inhibitor, clade F (alpha-2 antiplasmin, pigment epithelium derived factor), member 1), EDN3 (endothelin 3), DHFR (dihydrofolate reductase), GAS6 (growth arrest-specific 6), SMPD1 (sphingomyelin phosphodiesterase 1, acid lysosomal), UCP2 (uncoupling protein 2 (mitochondrial, proton carrier)), TFAP2A (transcription factor AP-2 alpha (activating enhancer binding protein 2 alpha)), C4BPA (complement component 4 binding protein, alpha), SERPINF2 (serpin peptidase inhibitor, clade F (alpha-2 antiplasmin, pigment epithelium derived factor), member 2), TYMP (thymidine phosphorylase), ALPP (alkaline phosphatase, placental (Regan isozyme)), CXCR2 (chemokine (C—X—C motif) receptor 2), SLC39A3 (solute carrier family 39 (zinc transporter), member 3), ABCG2 (ATP-binding cassette, sub-family G (WHITE), member 2), ADA (adenosine deaminase), JAK3 (Janus kinase 3), HSPA1A (heat shock 70 kDa protein 1A), FASN (fatty acid synthase), FGF1 (fibroblast growth factor 1 (acidic)), F 11 (coagulation factor XI), ATP7A (ATPase, Cu++ transporting, alpha polypeptide), CR1 (complement component (3b/4b) receptor 1 (Knops blood group)), GFAP (glial fibrillary acidic protein), ROCK1 (Rho-associated, coiled-coil containing protein kinase 1), MECP2 (methyl CpG binding protein 2 (Rett syndrome)), MYLK (myosin light chain kinase), BCHE (butyrylcholinesterase), LIPE (lipase, hormone-sensitive), PRDX5 (peroxiredoxin 5), ADORA1 (adenosine A1 receptor), WRN (Werner syndrome, RecQ helicase-like), CXCR3 (chemokine (C—X—C motif) receptor 3), CD81 (CD81 molecule), SMAD7 (SMAD family member 7), LAMC2 (laminin, gamma 2), MAP3K5 (mitogen-activated protein kinase kinase kinase 5), CHGA (chromogranin A (parathyroid secretory protein 1)), IAPP (islet amyloid polypeptide), RHO (rhodopsin), ENPP1 (ectonucleotide pyrophosphatase/phosphodiesterase 1), PTHLH (parathyroid hormone-like hormone), NRG1 (neuregulin 1), VEGFC (vascular endothelial growth factor C), ENPEP (glutamyl aminopeptidase (aminopeptidase A)), CEBPB (CCAAT/enhancer binding protein (C/EBP), beta), NAGLU (N-acetylglucosaminidase, alpha-), F2RL3 (coagulation factor II (thrombin) receptor-like 3), CX3CL1 (chemokine (C-X3-C motif) ligand 1), BDKRB1 (bradykinin receptor B1), ADAMTS13 (ADAM metallopeptidase with thrombospondin type 1 motif, 13), ELANE (elastase, neutrophil expressed), ENPP2 (ectonucleotide pyrophosphatase/phosphodiesterase 2), CISH (cytokine inducible SH2-containing protein), GAST (gastrin), MYOC (myocilin, trabecular meshwork inducible glucocorticoid response), ATP1A2 (ATPase, Na+/K+ transporting, alpha 2 polypeptide), NF1 (neurofibromin 1), GJB1 (gap junction protein, beta 1, 32 kDa), MEF2A (myocyte enhancer factor 2A), VCL (vinculin), BMPR2 (bone morphogenetic protein receptor, type II (serine/threonine kinase)), TUBB (tubulin, beta), CDC42 (cell division cycle 42 (GTP binding protein, 25 kDa)), KRT18 (keratin 18), HSF1 (heat shock transcription factor 1), MYB (v-myb myeloblastosis viral oncogene homolog (avian)), PRKAA2 (protein kinase, AMP-activated, alpha 2 catalytic subunit), ROCK2 (Rho-associated, coiled-coil containing protein kinase 2), TFPI (tissue factor pathway inhibitor (lipoprotein-associated coagulation inhibitor)), PRKG1 (protein kinase, cGMP-dependent, type I), BMP2 (bone morphogenetic protein 2), CTNND1 (catenin (cadherin-associated protein), delta 1), CTH (cystathionase (cystathionine gamma-lyase)), CTSS (cathepsin S), VAV2 (vav 2 guanine nucleotide exchange factor), NPY2R (neuropeptide Y receptor Y2), IGFBP2 (insulin-like growth factor binding protein 2, 36 kDa), CD28 (CD28 molecule), GSTA1 (glutathione S-transferase alpha 1), PPIA (peptidylprolyl isomerase A (cyclophilin A)), APOH (apolipoprotein H (beta-2-glycoprotein I)), S100A8 (S100 calcium binding protein A8), IL11 (interleukin 11), ALOX15 (arachidonate 15-lipoxygenase), FBLN1 (fibulin 1), NR1H3 (nuclear receptor subfamily 1, group H, member 3), SCD (stearoyl-CoA desaturase (delta-9-desaturase)), GIP (gastric inhibitory polypeptide), CHGB (chromogranin B (secretogranin 1)), PRKCB (protein kinase C, beta), SRD5A1 (steroid-5-alpha-reductase, alpha polypeptide 1 (3-oxo-5 alpha-steroid delta 4-dehydrogenase alpha 1)), HSD11B2 (hydroxysteroid (11-beta) dehydrogenase 2), CALCRL (calcitonin receptor-like), GALNT2 (UDP-N-acetyl-alpha-D-galactosamine:polypeptide N-acetylgalactosaminyltransferase 2 (GalNAc-T2)), ANGPTL4 (angiopoietin-like 4), KCNN4 (potassium intermediate/small conductance calcium-activated channel, subfamily N, member 4), PIK3C2A (phosphoinositide-3-kinase, class 2, alpha polypeptide), HBEGF (heparin-binding EGF-like growth factor), CYP7A1 (cytochrome P450, family 7, subfamily A, polypeptide 1), HLA-DRB5 (major histocompatibility complex, class II, DR beta 5), BNIP3 (BCL2/adenovirus E1B 19 kDa interacting protein 3), GCKR (glucokinase (hexokinase 4) regulator), S100A12 (S100 calcium binding protein A12), *PADI4* (peptidyl arginine deiminase, type IV), HSPA14 (heat shock 70 kDa protein 14), CXCR1 (chemokine (C—X—C motif) receptor 1), H19 (H19, imprinted maternally expressed transcript (non-protein coding)), KRTAP19-3 (keratin associated protein 19-3), IDDM2 (insulin-dependent diabetes mellitus 2), RAC2 (ras-related C3 botulinum toxin substrate 2 (rho family, small GTP binding protein Rac2)), RYR1 (ryanodine receptor 1 (skeletal)), CLOCK (clock homolog (mouse)), NGFR (nerve growth factor receptor (TNFR superfamily, member 16)), DBH (dopamine beta-hydroxylase (dopamine beta-monooxygenase)), CHRNA4 (cholinergic receptor, nicotinic, alpha 4), CACNA1C (calcium channel, voltage-dependent, L type, alpha 1C subunit), PRKAG2 (protein kinase, AMP-activated, gamma 2 non-catalytic subunit), CHAT (choline acetyltransferase), PTGDS (prostaglandin D2 synthase 21 kDa (brain)), NR1H2 (nuclear receptor subfamily 1, group H, member 2), TEK (TEK tyrosine kinase, endothelial), VEGFB (vascular endothelial growth factor B), MEF2C (myocyte enhancer factor 2C), MAPKAPK2 (mitogen-activated protein kinase-activated protein kinase 2), TNFRSF11A (tumor necrosis factor receptor superfamily, member 11a, NFKB activator), HSPA9 (heat shock 70 kDa protein 9 (mortalin)), CYSLTR1 (cysteinyl leukotriene receptor 1), MAT1A (methionine adenosyltransferase I, alpha), OPRL1 (opiate receptor-like 1), IMPA1 (inositol(myo)-1(or 4)-monophosphatase 1), CLCN2 (chloride channel 2), DLD (dihydrolipoamide dehydrogenase), PSMA6 (proteasome (prosome, macropain) subunit, alpha type, 6), PSMB8 (proteasome (prosome, macropain) subunit, beta type, 8 (large multifunctional peptidase 7)), CHI3L1 (chitinase 3-like 1 (cartilage glycoprotein-39)), ALDH1B1 (aldehyde dehydrogenase 1 family, member B1), PARP2 (poly (ADP-ribose) polymerase 2), STAR (steroidogenic acute regulatory protein), LBP (lipopolysaccharide binding protein), ABCC6 (ATP-binding cassette, sub-family C(CFTR/MRP), member 6), RGS2 (regulator of G-protein signaling 2, 24 kDa), EFNB2 (ephrin-B2), GJB6 (gap junction protein, beta 6, 30 kDa), APOA2 (apolipoprotein A-II), AMPD1 (adenosine monophosphate deaminase 1), DYSF (dysferlin, limb girdle muscular dystrophy 2B (autosomal recessive)), FDFT1 (farnesyl-diphosphate farnesyltransferase 1), EDN2 (endothelin 2), CCR6 (chemokine (C—C motif) receptor 6), GJB3 (gap junction protein, beta 3, 31 kDa), IL1RL1 (interleukin 1 receptor-like 1), ENTPD1 (ectonucleoside triphosphate diphosphohydrolase 1), BBS4 (Bardet-Biedl syndrome 4), CELSR2 (cadherin, EGF LAG seven-pass G-type receptor 2 (flamingo homolog, *Drosophila*)), FUR (F11 receptor), RAPGEF3 (Rap guanine nucleotide exchange factor (GEF) 3), HYAL1 (hyaluronoglucosaminidase 1), ZNF259 (zinc finger protein 259), ATOX1 (ATX1 antioxidant protein 1 homolog (yeast)), ATF6 (activating transcription factor 6), KHK (ketohexokinase (fructokinase)), SAT1 (spermidine/spermine N1-acetyltransferase 1), GGH (gamma-glutamyl hydrolase (conjugase, folylpolygammaglutamyl hydrolase)), TIMP4 (TIMP metallopeptidase inhibitor 4), SLC4A4 (solute carrier family 4, sodium bicarbonate cotransporter, member 4), PDE2A (phosphodiesterase 2A, cGMP-stimulated), PDE3B (phosphodiesterase 3B, cGMP-inhibited), FADS1 (fatty acid desaturase 1), FADS2 (fatty acid desaturase 2), TMSB4X (thymosin beta 4, X-linked), TXNIP (thioredoxin interacting protein), LIMS1 (LIM and senescent cell antigen-like domains 1), RHOB (ras homolog gene family, member B), LY96 (lymphocyte antigen 96), FOXO1 (forkhead box O1), PNPLA2 (patatin-like phospholipase domain containing 2), TRH (thyrotropin-releasing hormone), GJC1 (gap junction protein, gamma 1, 45 kDa), SLC17A5 (solute carrier family 17 (anion/sugar transporter), member 5), FTO (fat mass and obesity associated), GJD2 (gap junction protein, delta 2, 36 kDa), PSRC1 (proline/serine-rich coiled-coil 1), CASP12 (caspase 12 (gene/pseudogene)), GPBAR1 (G protein-coupled bile acid receptor 1), PXK (PX domain containing serine/threonine kinase), IL33 (interleukin 33), TRIB1 (tribbles homolog 1 (*Drosophila*)), PBX4 (pre-B-cell leukemia homeobox 4), NUPR1 (nuclear protein, transcriptional regulator, 1), 15-Sep(15 kDa selenoprotein), CILP2 (cartilage intermediate layer protein 2), TERC (telomerase RNA component), GGT2 (gamma-glutamyltransferase 2), MT-CO1 (mitochondrially encoded cytochrome c oxidase I), and UOX (urate oxidase, pseudogene). Any of these sequences, may be a target for the CRISPR-Cas system, e.g., to address mutation.

In an additional embodiment, the chromosomal sequence may further be selected from Ponl (paraoxonase 1), LDLR (LDL receptor), ApoE (Apolipoprotein E), Apo B-100 (Apolipoprotein B-100), ApoA (Apolipoprotein(a)), ApoAl (Apolipoprotein A1), CBS (Cystathione B-synthase), Glycoprotein IIb/IIb, MTHRF (5,10-methylenetetrahydrofolate reductase (NADPH), and combinations thereof. In one iteration, the chromosomal sequences and proteins encoded by chromosomal sequences involved in cardiovascular disease may be chosen from CacnalC, Sodl, Pten, Ppar(alpha), Apo E, Leptin, and combinations thereof as target(s) for the CRISPR-Cas system.

Treating Diseases of the Liver and Kidney

The present invention also contemplates delivering the system described herein, e.g. Type V effector protein systems, to the liver and/or kidney. Delivery strategies to induce cellular uptake of the therapeutic nucleic acid include physical force or vector systems such as viral-, lipid- or complex-based delivery, or nanocarriers. From the initial applications with less possible clinical relevance, when nucleic acids were addressed to renal cells with hydrodynamic high pressure injection systemically, a wide range of gene therapeutic viral and non-viral carriers have been applied already to target posttranscriptional events in different animal kidney disease models in vivo (Csaba Révész and Péter Hamar (2011). Delivery Methods to Target RNAs in the Kidney, Gene Therapy Applications, Prof. Chunsheng Kang (Ed.), ISBN: 978-953-307-541-9, InTech, Available from: www.intechop en. com/books/gene-therapy-applications/delivery-methods-to-target-rnas-inthe-kidney). Delivery methods to the kidney may include those in Yuan et al. (Am J Physiol Renal Physiol 295: F605-F617, 2008) investigated whether in vivo delivery of small interfering RNAs (siRNAs) targeting the 12/15-lipoxygenase (12/15-LO) pathway of arachidonate acid metabolism can ameliorate renal injury and diabetic nephropathy (DN) in a streptozotocininjected mouse model of type 1 diabetes. To achieve greater in vivo access and siRNA expression in the kidney, Yuan et al. used double-stranded 12/15-LO siRNA oligonucleotides conjugated with cholesterol. About 400 µg of siRNA was injected subcutaneously into mice. The method of Yuang et al. may be applied to the CRISPR Cas system of the present invention contemplating a 1-2 g subcutaneous injection of CRISPR Cas conjugated with cholesterol to a human for delivery to the kidneys.

Molitoris et al. (J Am Soc Nephrol 20: 1754-1764, 2009) exploited proximal tubule cells (PTCs), as the site of oligonucleotide reabsorption within the kidney to test the efficacy of siRNA targeted to p53, a pivotal protein in the apoptotic pathway, to prevent kidney injury. Naked synthetic siRNA to p53 injected intravenously 4 h after ischemic injury maximally protected both PTCs and kidney function. Molitoris et al.'s data indicates that rapid delivery of siRNA to proximal tubule cells follows intravenous administration. For dose-response analysis, rats were injected with doses of siP53, 0.33; 1, 3, or 5 mg/kg, given at the same four time points, resulting in cumulative doses of 1.32; 4, 12, and 20 mg/kg, respectively. All siRNA doses tested produced a SCr reducing effect on day one with higher doses being effective over approximately five days compared with PBS-treated ischemic control rats. The 12 and 20 mg/kg cumulative doses provided the best protective effect. The method of Molitoris et al. may be applied to the nucleic acid-targeting system of the present invention contemplating 12 and 20 mg/kg cumulative doses to a human for delivery to the kidneys.

Thompson et al. (Nucleic Acid Therapeutics, Volume 22, Number 4, 2012) reports the toxicological and pharmacokinetic properties of the synthetic, small interfering RNA I5NP following intravenous administration in rodents and nonhuman primates. I5NP is designed to act via the RNA interference (RNAi) pathway to temporarily inhibit expression of the pro-apoptotic protein p53 and is being developed to protect cells from acute ischemia/reperfusion injuries such as acute kidney injury that can occur during major cardiac surgery and delayed graft function that can occur following renal transplantation. Doses of 800 mg/kg I5NP in rodents, and 1,000 mg/kg I5NP in nonhuman primates, were required to elicit adverse effects, which in the monkey were isolated to direct effects on the blood that included a sub-clinical activation of complement and slightly increased clotting times. In the rat, no additional adverse effects were observed with a rat analogue of I5NP, indicating that the effects likely represent class effects of synthetic RNA duplexes rather than toxicity related to the intended pharmacologic activity of I5NP. Taken together, these data support clinical testing of intravenous administration of I5NP for the preservation of renal function following acute ischemia/reperfusion injury. The no observed adverse effect level (NOAEL) in the monkey was 500 mg/kg. No effects on cardiovascular, respiratory, and neurologic parameters were observed in monkeys following i.v. administration at dose levels up to 25 mg/kg. Therefore, a similar dosage may be contemplated for intravenous administration of CRISPR Cas to the kidneys of a human.

Shimizu et al. (J Am Soc Nephrol 21: 622-633, 2010) developed a system to target delivery of siRNAs to glomeruli via poly(ethylene glycol)-poly(L-lysine)-based vehicles. The siRNA/nanocarrier complex was approximately 10 to 20 nm in diameter, a size that would allow it to move across the fenestrated endothelium to access to the mesangium. After intraperitoneal injection of fluorescence-labeled siRNA/nanocarrier complexes, Shimizu et al. detected siRNAs in the blood circulation for a prolonged time. Repeated intraperitoneal administration of a mitogen-activated protein kinase 1 (MAPK1) siRNA/nanocarrier complex suppressed glomerular MAPK1 mRNA and protein expression in a mouse model of glomerulonephritis. For the investigation of siRNA accumulation, Cy5-labeled siRNAs complexed with PIC nanocarriers (0.5 ml, 5 nmol of siRNA content), naked Cy5-labeled siRNAs (0.5 ml, 5 nmol), or Cy5-labeled siRNAs encapsulated in HVJ-E (0.5 ml, 5 nmol of siRNA content) were administrated to BALBc mice. The method of Shimizu et al. may be applied to the nucleic acid-targeting system of the present invention contemplating a dose of about of 10-20 µmol CRISPR Cas complexed with nanocarriers in about 1-2 liters to a human for intraperitoneal administration and delivery to the kidneys.

Delivery methods to the kidney are summarized as follows:

TABLE 7

| Delivery method | Carrier | Target RNA | Disease | Model | Functional assays | Author |
|---|---|---|---|---|---|---|
| Hydrodynamic/Lipid | TransIT In Vivo Gene Delivery System, DOTAP | p85α | Acute renal injury | Ischemia-reperfusion | Uptake, biodistribution | Larson et al., Surgery, (August 2007), Vol. 142, No. 2, pp. (262-269) |
| Hydrodynamic/Lipid | Lipofectamine 2000 | Fas | Acute renal injury | Ischemia-reperfusion | Blood urea nitrogen, Fas Immunohistochemistry, apoptosis, histological scoring | Hamar et al., Proc Natl Acad Sci, (October 2004), Vol. 101, No. 41, pp. (14883-14888) |
| Hydrodynamic | n.a. | Apoptosis cascade elements | Acute renal injury | Ischemia-reperfusion | n.a. | Zheng et al., Am J Pathol, (October 2008), Vol. 173, No. 4, pp. (973-980) |
| Hydrodynamic | n.a. | Nuclear factor kappa-b (NFkB) | Acute renal injury | Ischemia-reperfusion | n.a. | Feng et al., Transplantation, (May 2009), Vol. 87, No. 9, pp. (1283-1289) |
| Hydrodynamic/Viral | Lipofectamine 2000 | Apoptosis antagonizing transcription factor (AATF) | Acute renal injury | Ischemia-reperfusion | Apoptosis, oxidative stress, caspase activation, membrane lipid peroxidation | Xie & Guo, Am Soc Nephrol, (December 2006), Vol. 17, No. 12, pp. (3336-3346) |
| Hydrodynamic | pBAsi mU6 Neo/TransIT-EE Hydrodynamic Delivery System | Gremlin | Diabetic nephropathy | Streptozotozin-induced diabetes | Proteinuria, serum creatinine, glomerular and tubular diameter, collagen type IV/BMP7 expression | Q. Zhang et al., PloS ONE, (July 2010), Vol. 5, No. 7, e11709, pp. (1-13) |
| Viral/Lipid | pSUPER vector/Lipofectamine | TGF-β type II receptor | Interstitial renal fibrosis | Unilateral urethral obstruction | α-SMA expression, collagen content, | Kushibikia et al., J Controlled Release, (July 2005), Vol. 105, No. 3, pp. (318-331) |
| Viral | Adeno-associated virus-2 | Mineral corticoid receptor | Hyper-tension caused renal damage | Cold-induced hypertension | blood pressure, serum albumin, serum urea nitrogen, serum creatinine, kidney weight, urinary sodium | Wang et al., Gene Therapy, (July 2006), Vol. 13, No. 14, pp. (1097-1103) |
| Hydrodynamic/Viral | pU6 vector | Luciferase | n.a. | n.a. | uptake | Kobayashi et al., Journal of Pharmacology and Experimental Therapeutics, (February 2004), Vol. 308, No. 2, pp. (688-693) |
| Lipid | Lipoproteins, albumin | apoB1, apoM | n.a. | n.a. | Uptake, binding affinity to lipoproteins and albumin | Wolfrum et al., Nature Biotechnology, (September 2007), Vol. 25, No. 10, pp. (1149-1157) |
| Lipid | Lipofectamine2000 | p53 | Acute renal injury | Ischemic and cisplatin-induced acute injury | Histological scoring, apoptosis | Molitoris et al., J Am Soc Nephrol, (August 2009), Vol. 20, No. 8, pp. (1754-1764) |
| Lipid | DOTAP/DOPE, DOTAP/DOPE/DOPE-PEG2000 | COX-2 | Breast adeno-carcinoma | MDA-MB-231 breast cancer xenograft-bearing mouse | Cell viability, uptake | Mikhaylova et al., Cancer Gene Therapy, (March 2011), Vol. 16, No. 3, pp. (217-226) |

TABLE 7-continued

| Delivery method | Carrier | Target RNA | Disease | Model | Functional assays | Author |
|---|---|---|---|---|---|---|
| Lipid | Cholesterol | 12/15-lipoxygenase | Diabetic nephro-pathy | Streptozotocin-induced diabetes | Albuminuria, urinary creatinine, histology, type I and IV collagen, TGF-β, fibronectin, plasminogen activator inhibitor 1 | Yuan et al., Am J Physiol Renal Physiol, (June 2008), Vol. 295, pp. (F605-F617) |
| Lipid | Lipofectamine 2000 | Mitochondrial membrane 44 (TIM44) | Diabetic nephro-pathy | Streptozotocin-induced diabetes | Cell proliferation and apoptosis, histology, ROS, mitochondrial import of Mn-SOD and glutathione peroxidase, cellular membrane polarization | Y. Zhang et al., J Am Soc Nephrol, (April 2006), Vol. 17, No. 4, pp. (1090-1101) |
| Hydrodynamic/Lipid | Proteolipo-some | RLIP76 | Renal carcinoma | Caki-2 kidney cancer xenograft-bearing mouse | uptake | Singhal et al., Cancer Res, (May 2009), Vol. 69, No. 10, pp. (4244-4251) |
| Polymer | PEGylated PEI | Luciferase pGL3 | n.a. | n.a. | Uptake, biodistribution, erythrocyte aggregation | Malek et al., Toxicology and Applied Pharmacology, (April 2009), Vol. 236, No. 1, pp. (97-108) |
| Polymer | PEGylated poly-L-lysine | MAPK1 | Lupus glomerulo-nephritis | Glomerulo-nephritis | Proteinuria, glomerulosclerosis, TGF-β, fibronectin, plasminogen activator inhibitor 1 | Shimizu et al., J Am Soc Nephrology, (April 2010), Vol. 21, No. 4, pp. (622-633) |
| Polymer/Nano particle | Hyaluronic acid/Quantum dot/ PEI | VEGF | Kidney cancer/ melanoma | B16F1 melanoma tumor-bearing mouse | Biodistribution, citotoxicity, tumor volume, endocytosis | Jiang et al., Molecular Pharmaceutics, (May-June 2009), Vol. 6, No. 3, pp. (727-737) |
| Polymer/Nano particle | PEGylated polycaprolactone nanofiber | GAPDH | n.a. | n.a. | cell viability, uptake | Cao et al, J Controlled Release, (June 2010), Vol. 144, No. 2, pp. (203-212) |
| Aptamer | Spiegelmer mNOX-E36 | CC chemokine ligand 2 | Glomerulo-sclerosis | Uninephrecto-mized mouse | urinary albumin, urinary creatinine, histopathology, glomerular filtration rate, macrophage count, serum Ccl2, Mac- 2+, Ki-67+ | Ninichuk et al., Am J Pathol, (March 2008), Vol. 172, No. 3, pp. (628-637) |
| Aptamer | Aptamer NOX-F37 | vasopressin (AVP) | Congestive heart failure | n.a. | Binding affinity to D-AVP, Inhibition of AVP Signaling, Urine osmolality and sodium concentration, | Purschke et al., Proc Natl Acad Sci, (March 2006), Vol. 103, No. 13, pp. (5173-5178) |

Targeting the Liver or Liver Cells

Targeting liver cells is provided. This may be in vitro or in vivo. Hepatocytes are preferred. Delivery of the systems herein may be via viral vectors, especially AAV (and in particular AAV2/6) vectors. These may be administered by intravenous injection.

A preferred target for liver, whether in vitro or in vivo, is the albumin gene. This is a so-called 'safe harbor" as albumin is expressed at very high levels and so some reduction in the production of albumin following successful gene editing is tolerated. It is also preferred as the high levels of expression seen from the albumin promoter/enhancer allows for useful levels of correct or transgene production (from the inserted donor template) to be achieved even if only a small fraction of hepatocytes are edited.

Intron 1 of albumin has been shown by Wechsler et al. (reported at the 57th Annual Meeting and Exposition of the American Society of Hematology—abstract available online at ash.confex.com/ash/2015/webprogram/Paper86495.html and presented on 6 Dec. 2015) to be a suitable target site. Their work used Zn Fingers to cut the DNA at this target site, and suitable guide sequences can be generated to guide cleavage at the same site by a CRISPR protein.

The use of targets within highly-expressed genes (genes with highly active enhancers/promoters) such as albumin may also allow a promoterless donor template to be used, as reported by Wechsler et al. and this is also broadly applicable outside liver targeting. Other examples of highly-expressed genes are known.

Other Disease of the Liver

In particular embodiments, the systems of the present invention may be used in the treatment of liver disorders such as transthyretin amyloidosis (ATTR), alpha-1 antitrypsin deficiency and other hepatic-based inborn errors of metabolism. FAP is caused by a mutation in the gene that encodes transthyretin (TTR). While it is an autosomal dominant disease, not all carriers develop the disease. There are over 100 mutations in the TTR gene known to be associated with the disease. Examples of common mutations include V30M. The principle of treatment of TTR based on gene silencing has been demonstrated by studies with iRNA (Ueda et al. 2014 Transl Neurogener. 3:19). Wilson's Disease (WD) is caused by mutations in the gene encoding ATP7B, which is found exclusively in the hepatocyte. There are over 500 mutations associated with WD, with increased prevalence in specific regions such as East Asia. Other examples are A1ATD (an autosomal recessive disease caused by mutations in the SERPINA1 gene) and PKU (an autosomal recessive disease caused by mutations in the phenylalanine hydroxylase (PAH) gene).

Liver-Associated Blood Disorders, Especially Hemophilia and in Particular Hemophilia B Successful gene editing of hepatocytes has been achieved in mice (both in vitro and in vivo) and in non-human primates (in vivo), showing that treatment of blood disorders through gene editing/genome engineering in hepatocytes is feasible. In particular, expression of the human F9 (hF9) gene in hepatocytes has been shown in non-human primates indicating a treatment for Hemophillia B in humans.

Wechsler et al. reported at the 57th Annual Meeting and Exposition of the American Society of Hematology (abstract presented 6 Dec. 2015 and available online at ash.confex.com/ash/2015/webprogram/Paper86495.html) that they has successfully expressed human F9 (hF9) from hepatocytes in non-human primates through in vivo gene editing. This was achieved using 1) two zinc finger nucleases (ZFNs) targeting intron 1 of the albumin locus, and 2) a human F9 donor template construct. The ZFNs and donor template were encoded on separate hepatotropic adeno-associated virus serotype 2/6 (AAV2/6) vectors injected intravenously, resulting in targeted insertion of a corrected copy of the hF9 gene into the albumin locus in a proportion of liver hepatocytes.

The albumin locus was selected as a "safe harbor" as production of this most abundant plasma protein exceeds 10 g/day, and moderate reductions in those levels are well-tolerated. Genome edited hepatocytes produced normal hFIX (hF9) in therapeutic quantities, rather than albumin, driven by the highly active albumin enhancer/promoter. Targeted integration of the hF9 transgene at the albumin locus and splicing of this gene into the albumin transcript was shown.

Mice studies: C57BL/6 mice were administered vehicle (n=20) or AAV2/6 vectors (n=25) encoding mouse surrogate reagents at $1.0 \times 10^{13}$ vector genome (vg)/kg via tail vein injection. ELISA analysis of plasma hFIX in the treated mice showed peak levels of 50-1053 ng/mL that were sustained for the duration of the 6-month study. Analysis of FIX activity from mouse plasma confirmed bioactivity commensurate with expression levels.

Non-human primate (NHP) studies: a single intravenous co-infusion of AAV2/6 vectors encoding the NHP targeted albumin-specific ZFNs and a human F9 donor at $1.2 \times 10^{13}$ vg/kg (n=5/group) resulted in >50 ng/mL (>1% of normal) in this large animal model. The use of higher AAV2/6 doses (up to $1.5 \times 10^{14}$ vg/kg) yielded plasma hFIX levels up to 1000 ng/ml (or 20% of normal) in several animals and up to 2000 ng/ml (or 50% of normal) in a single animal, for the duration of the study (3 months).

The treatment was well tolerated in mice and NHPs, with no significant toxicological findings related to AAV2/6 ZFN+donor treatment in either species at therapeutic doses. Sangamo (CA, USA) has since applied to the FDA, and been granted, permission to conduct the world's first human clinical trial for an in vivo genome editing application. This follows on the back of the EMEA's approval of the Glybera gene therapy treatment of lipoprotein lipase deficiency.

Accordingly, it is preferred, in some embodiments, that any or all of the following are used: AAV (especially AAV2/6) vectors, preferably administered by intravenous injection; Albumin as target for gene editing/insertion of transgene/template—especially at intron 1 of albumin; human F9 donor template; and/ora promoterless donor template.

Hemophilia B

Accordingly, in some embodiments, it is preferred that the present invention is used to treat Hemophilia B. As such it is preferred that F9 (Factor IX) is targeted through provision of a suitable guide RNA. The enzyme and the guide may ideally be targeted to the liver where F9 is produced, although they can be delivered together or separately. A template is provided, in some embodiments, and that this is the human F9 gene. It will be appreciated that the hF9 template comprises the wt or 'correct' version of hF9 so that the treatment is effective. In some embodiments, a two-vector system may be used—one vector for the Type V effector and one vector for the repair template(s). The repair template may include two or more repair templates, for example, two F9 sequences from different mammalian species. In some embodiments, both a mouse and human F9 sequence are provided. This is may be delivered to mice. Yang Yang, John White, McMenamin Deirdre, and Peter Bell, PhD, presenting at 58th Annual American Society of Hematology Meeting (November 2016), report that this increases potency and accuracy. The second vector inserted the human sequence of factor IX into the mouse genome. In some embodiments, the targeted insertion leads to the expression of a chimeric hyperactive factor IX protein. In some embodiments, this is under the control of the native mouse factor IX promoter. Injecting this two-component system (vector 1 and vector 2) into newborn and adult "knock-out" mice at increasing doses led to expression and activity of stable factor IX activity at normal (or even higher) levels for over four months. In the case of treating humans, a native human F9 promoter may be used instead. In some embodiments, the wt phenotype is restored.

In an alternative embodiment, the hemophilia B version of F9 may be delivered so as to create a model organism, cell or cell line (for example a murine or non-human primate model organism, cell or cell line), the model organism, cell or cell line having or carrying the Hemophilia B phenotype, i.e. an inability to produce wt F9.

Hemophilia A

In some embodiments, the F9 (factor IX) gene may be replaced by the F8 (factor VIII) gene described above, leading to treatment of Hemophilia A (through provision of a correct F8 gene) and/or creation of a Hemophilia A model organism, cell or cell line (through provision of an incorrect, Hemophilia A version of the F8 gene).

Hemophilia C

In some embodiments, the F9 (factor IX) gene may be replaced by the F11 (factor XI) gene described above, leading to treatment of Hemophilia C (through provision of a correct F11 gene) and/or creation of a Hemophilia C model organism, cell or cell line (through provision of an incorrect, Hemophilia C version of the F11 gene).

Transthyretin Amyloidosis

Transthyretin is a protein, mainly produced in the liver, present in the serum and CSF which carries thyroxin hormone and retinol binding protein bound to retinol (Vitamin A). Over 120 different mutations can cause Transthyretin amyloidosis (ATTR), a heritable genetic disorder wherein mutant forms of the protein aggregate in tissues, particularly the peripheral nervous system, causing polyneuropathy.

Familial amyloid polyneuropathy (FAP) is the most common TTR disorder and, in 2014, was thought to affect 47 per 100,000 people in Europe. A mutation in the TTR gene of Va130Met is thought be the most common mutation, causing an estimated 50% of FAP cases. In the absence of a liver transplant, the only known cure to date, the disease is usually fatal within a decade of diagnosis. The majority of cases are monogenic.

In mouse models of ATTR, the TTR gene may be edited in a dose dependent manner by the delivery of CRISPR/Cas9. In some embodiments, the Type V effector is provided as mRNA. In some embodiments, Type V effector mRNA and guide RNA are packaged in LNPs. A system comprising Type V effector mRNA and guide RNA packaged in LNPs achieved up to 60% editing efficiency in the liver, with serum TTR levels being reduced by up to 80%. In some embodiments, therefore, Transthyretin is targeted, in particular correcting for the Va130Met mutation. In some embodiments, therefore, ATTR is treated.

Alpha-1 Antitrypsin Deficiency

Alpha-1 Antitrypsin (A1AT) is a protein produced in the liver which primarily functions to decrease the activity of neutrophil elastase, an enzyme which degrades connective tissue, in the lungs. Alpha-1 Antitrypsin Deficiency (ATTD) is a disease caused by mutation of the SERPINA1 gene, which encodes A1AT. Impaired production of A1AT leads to a gradual degradation of the connective tissue of the lung resulting in emphysema like symptoms.

Several mutations can cause ATTD, though the most common mutations are Glu342Lys (referred to as Z allele, wild-type is referred to as M) or Glu264Val (referred to as the S allele), and each allele contributes equally to the disease state, with two affected alleles resulting in more pronounced pathophysiology. These results not only resulted in degradation of the connective tissue of sensitive organs, such as the lung, but accumulation of the mutants in the liver can result in proteotoxicity. Current treatments focus on the replacement of A1 AT by injection of protein retrieved from donated human plasma. In severe cases a lung and/or liver transplant may be considered.

The common variants of the disease are again monogenic. In some embodiments, the SERPINA1 gene is targeted. In some embodiments, the Glu342Lys mutation (referred to as Z allele, wild-type is referred to as M) or the Glu264Val mutation (referred to as the S allele) are corrected for. In some embodiments, therefore, the faulty gene would require replacement by the wild-type functioning gene. In some embodiments, a knockout and repair approach is required, so a repair template is provided. In the case of bi-allelic mutations, in some embodiments only one guide RNA would be required for homozygous mutations, but in the case of heterozygous mutations two guide RNAs may be required. Delivery is, in some embodiments, to the lung or liver.

Inborn Errors of Metabolism

Inborn errors of metabolism (IEMs) are an umbrella group of diseases which affect metabolic processes. In some embodiments, an IEM is to be treated. The majority of these diseases are monogenic in nature (e.g. phenylketonuria) and the pathophysiology results from either the abnormal accumulation of substances which are inherently toxic, or mutations which result in an inability to synthesize essential substances. Depending on the nature of the IEM, CRISPR/Type V effector may be used to facilitate a knock-out alone, or in combination with replacement of a faulty gene via a repair template. Exemplary diseases that may benefit from CRISPR/Type V effector technology are, in some embodiments: primary hyperoxaluria type 1 (PH1), argininosuccinic lyase deficiency, ornithine transcarbamylase deficiency, phenylketonuria, or PKU, and maple syrup urine disease.

Treating Epithelial and Lung Diseases

The present invention also contemplates delivering the system described herein, e.g. CAST systems, to one or both lungs.

Although AAV-2-based vectors were originally proposed for CFTR delivery to CF airways, other serotypes such as AAV-1, AAV-5, AAV-6, and AAV-9 exhibit improved gene transfer efficiency in a variety of models of the lung epithelium (see, e.g., Li et al., Molecular Therapy, vol. 17 no. 12, 2067-277 December 2009). AAV-1 was demonstrated to be ~100-fold more efficient than AAV-2 and AAV-5 at transducing human airway epithelial cells in vitro, although AAV-1 transduced murine tracheal airway epithelia in vivo with an efficiency equal to that of AAV-5. Other studies have shown that AAV-5 is 50-fold more efficient than AAV-2 at gene delivery to human airway epithelium (HAE) in vitro and significantly more efficient in the mouse lung airway epithelium in vivo. AAV-6 has also been shown to be more efficient than AAV-2 in human airway epithelial cells in vitro and murine airways in vivo. The more recent isolate, AAV-9, was shown to display greater gene transfer efficiency than AAV-5 in murine nasal and alveolar epithelia in vivo with gene expression detected for over 9 months suggesting AAV may enable long-term gene expression in vivo, a desirable property for a CFTR gene delivery vector. Furthermore, it was demonstrated that AAV-9 could be readministered to the murine lung with no loss of CFTR expression and minimal immune consequences. CF and non-CF HAE cultures may be inoculated on the apical surface with 100 µl of AAV vectors for hours (see, e.g., Li et al., Molecular Therapy, vol. 17 no. 12, 2067-277 December 2009). The MOI may vary from $1\times10^3$ to $4\times10$ vector genomes/cell, depending on virus concentration and purposes of the experiments. The above cited vectors are contemplated for the delivery and/or administration of the invention.

Zamora et al. (Am J Respir Crit Care Med Vol 183. pp 531-538, 2011) reported an example of the application of an RNA interference therapeutic to the treatment of human infectious disease and also a randomized trial of an antiviral drug in respiratory syncytial virus (RSV)-infected lung transplant recipients. Zamora et al. performed a randomized, double-blind, placebocontrolled trial in LTX recipients with RSV respiratory tract infection. Patients were permitted to receive standard of care for RSV. Aerosolized ALN-RSV01 (0.6 mg/kg) or placebo was administered daily for 3 days. This study demonstrates that an RNAi therapeutic targeting RSV can be safely administered to LTX recipients with RSV infection. Three daily doses of ALN-RSVO1 did not result in any exacerbation of respiratory tract symptoms or impairment of lung function and did not exhibit any systemic proinflammatory effects, such as induction of cytokines or CRP. Pharmacokinetics showed only low, transient systemic exposure after inhalation, consistent with preclinical animal data showing that ALN-RSV01, administered intravenously or by inhalation, is rapidly cleared from the circulation through exonucleasemediated digestion and renal excretion. The method of Zamora et al. may be applied to the nucleic acid-targeting system of the present invention and an aerosolized CRISPR Cas, for example with a dosage of 0.6 mg/kg, may be contemplated for the present invention.

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector. In this instance, the following constructs are provided as examples: Cbh or EF1α promoter for Cas, U6 or H1 promoter for guide RNA),: A preferred arrangement is to use a CFTRdelta508 targeting guide, a repair template for deltaF508 mutation and a codon optimized Type V enzyme, with optionally one or more nuclear localization signal or sequence(s) (NLS(s)), e.g., two (2) NLSs. Constructs without NLS are also envisaged.

Treating Diseases of the Muscular System

The present invention also contemplates delivering the system described herein, e.g. CAST systems, to muscle(s).

Bortolanza et al. (Molecular Therapy vol. 19 no. 11, 2055-264 November 2011) shows that systemic delivery of RNA interference expression cassettes in the FRG1 mouse, after the onset of facioscapulohumeral muscular dystrophy (FSHD), led to a dose-dependent long-term FRG1 knockdown without signs of toxicity. Bortolanza et al. found that a single intravenous injection of $5 \times 10^{12}$ vg of rAAV6-sh1FRG1 rescues muscle histopathology and muscle function of FRG1 mice. In detail, 200 μl containing $2 \times 10^{12}$ or $5 \times 10^{12}$ vg of vector in physiological solution were injected into the tail vein using a 25-gauge Terumo syringe. The method of Bortolanza et al. may be applied to an AAV expressing CRISPR Cas and injected into humans at a dosage of about $2 \times 10^{15}$ or $2 \times 10^{16}$ vg of vector.

Dumonceaux et al. (Molecular Therapy vol. 18 no. 5, 881-887 May 2010) inhibit the myostatin pathway using the technique of RNA interference directed against the myostatin receptor AcvRIIb mRNA (sh-AcvRIIb). The restoration of a quasi-dystrophin was mediated by the vectorized U7 exon-skipping technique (U7-DYS). Adeno-associated vectors carrying either the sh-AcvrIIb construct alone, the U7-DYS construct alone, or a combination of both constructs were injected in the tibialis anterior (TA) muscle of dystrophic mdx mice. The injections were performed with $10^{11}$ AAV viral genomes. The method of Dumonceaux et al. may be applied to an AAV expressing CRISPR Cas and injected into humans, for example, at a dosage of about $10^{14}$ to about $10^{15}$ vg of vector.

Kinouchi et al. (Gene Therapy (2008) 15, 1126-1130) report the effectiveness of in vivo siRNA delivery into skeletal muscles of normal or diseased mice through nanoparticle formation of chemically unmodified siRNAs with atelocollagen (ATCOL). ATCOL-mediated local application of siRNA targeting myostatin, a negative regulator of skeletal muscle growth, in mouse skeletal muscles or intravenously, caused a marked increase in the muscle mass within a few weeks after application. These results imply that ATCOL-mediated application of siRNAs is a powerful tool for therapeutic use for diseases including muscular atrophy. MstsiRNAs (final concentration, 10 mM) were mixed with ATCOL (final concentration for local administration, 0.5%) (AteloGene, Kohken, Tokyo, Japan) according to the manufacturer's instructions. After anesthesia of mice (20-week-old male C57BL/6) by Nembutal (25 mg/kg, i.p.), the Mst-siRNA/ATCOL complex was injected into the masseter and biceps femoris muscles. The method of Kinouchi et al. may be applied to CRISPR Cas and injected into a human, for example, at a dosage of about 500 to 1000 ml of a 40 μM solution into the muscle. Hagstrom et al. (Molecular Therapy Vol. 10, No. 2, August 2004) describe an intravascular, nonviral methodology that enables efficient and repeatable delivery of nucleic acids to muscle cells (myofibers) throughout the limb muscles of mammals. The procedure involves the injection of naked plasmid DNA or siRNA into a distal vein of a limb that is transiently isolated by a tourniquet or blood pressure cuff. Nucleic acid delivery to myofibers is facilitated by its rapid injection in sufficient volume to enable extravasation of the nucleic acid solution into muscle tissue. High levels of transgene expression in skeletal muscle were achieved in both small and large animals with minimal toxicity. Evidence of siRNA delivery to limb muscle was also obtained. For plasmid DNA intravenous injection into a rhesus monkey, a three-way stopcock was connected to two syringe pumps (Model PHD 2000; Harvard Instruments), each loaded with a single syringe. Five minutes after a papaverine injection, pDNA (15.5 to 25.7 mg in 40-100 ml saline) was injected at a rate of 1.7 or 2.0 ml/s. This could be scaled up for plasmid DNA expressing CRISPR Cas of the present invention with an injection of about 300 to 500 mg in 800 to 2000 ml saline for a human. For adenoviral vector injections into a rat, $2 \times 10^9$ infectious particles were injected in 3 ml of normal saline solution (NSS). This could be scaled up for an adenoviral vector expressing CRISPR Cas of the present invention with an injection of about $1 \times 10^{13}$ infectious particles were injected in 10 liters of NSS for a human. For siRNA, a rat was injected into the great saphenous vein with 12.5 μg of a siRNA and a primate was injected into the great saphenous vein with 750 μg of a siRNA. This could be scaled up for a CRISPR Cas of the present invention, for example, with an injection of about 15 to about 50 mg into the great saphenous vein of a human.

See also, for example, WO2013163628 A2, Genetic Correction of Mutated Genes, published application of Duke University describes efforts to correct, for example, a frameshift mutation which causes a premature stop codon and a truncated gene product that can be corrected via nuclease mediated non-homologous end joining such as those responsible for Duchenne Muscular Dystrophy, ("DMD") a recessive, fatal, X-linked disorder that results in muscle degeneration due to mutations in the dystrophin gene. The majority of dystrophin mutations that cause DMD are deletions of exons that disrupt the reading frame and cause premature translation termination in the dystrophin gene. Dystrophin is a cytoplasmic protein that provides structural stability to the dystroglycan complex of the cell membrane that is responsible for regulating muscle cell integrity and function. The dystrophin gene or "DMD gene" as used interchangeably herein is 2.2 megabases at locus Xp21. The primary transcription measures about 2,400 kb with the mature mRNA being about 14 kb. 79 exons code for the protein which is over 3500 amino acids. Exon 51 is frequently adjacent to frame-disrupting deletions in DMD patients and has been targeted in clinical trials for oligonucleotide-based exon skipping. A clinical trial for the exon 51 skipping compound eteplirsen recently reported a significant functional benefit across 48 weeks, with an average of 47% dystrophin positive fibers compared to baseline. Mutations in exon 51 are ideally suited for permanent correction by NHEJ-based genome editing.

Min et al., "CRISPR-Cas9 corrects Duchenne muscular dystrophy exon 44 deletion mutations in mice and human cells," Science Advances 2019, vol 5 pp. eaav4324 describes correction of exon 44 deletion mutations by editing cardiomyocytes obtained from patient-derived induced pluripotent stem cells and the effect of varying relative dosages of CRISPR gene editing components. The methods may be modified to the nucleic acid-targeting system of the present invention.

The methods of US Patent Publication No. 20130145487 assigned to Cellectis, which relates to meganuclease variants to cleave a target sequence from the human dystrophin gene (DMD), may also be modified to for the nucleic acid-targeting system of the present invention.

Treating Diseases of the Skin

The present invention also contemplates delivering the system described herein, e.g. CAST systems, to the skin.

Hickerson et al. (Molecular Therapy—Nucleic Acids (2013) 2, e129) relates to a motorized microneedle array skin delivery device for delivering self-delivery (sd)-siRNA to human and murine skin. The primary challenge to translating siRNA-based skin therapeutics to the clinic is the development of effective delivery systems. Substantial effort has been invested in a variety of skin delivery technologies with limited success. In a clinical study in which skin was treated with siRNA, the exquisite pain associated with the hypodermic needle injection precluded enrollment of additional patients in the trial, highlighting the need for improved, more "patient-friendly" (i.e., little or no pain) delivery approaches. Microneedles represent an efficient way to deliver large charged cargos including siRNAs across the primary barrier, the stratum corneum, and are generally regarded as less painful than conventional hypodermic needles. Motorized "stamp type" microneedle devices, including the motorized microneedle array (MMNA) device used by Hickerson et al., have been shown to be safe in hairless mice studies and cause little or no pain as evidenced by (i) widespread use in the cosmetic industry and (ii) limited testing in which nearly all volunteers found use of the device to be much less painful than a flushot, suggesting siRNA delivery using this device will result in much less pain than was experienced in the previous clinical trial using hypodermic needle injections. The MMNA device (marketed as Triple-M or Tri-M by Bomtech Electronic Co, Seoul, South Korea) was adapted for delivery of siRNA to mouse and human skin. sd-siRNA solution (up to 300 µl of 0.1 mg/ml RNA) was introduced into the chamber of the disposable Tri-M needle cartridge (Bomtech), which was set to a depth of 0.1 mm. For treating human skin, deidentified skin (obtained immediately following surgical procedures) was manually stretched and pinned to a cork platform before treatment. All intradermal injections were performed using an insulin syringe with a 28-gauge 0.5-inch needle. The MMNA device and method of Hickerson et al. could be used and/or adapted to deliver the systems of the present invention, for example, at a dosage of up to 300 µl of 0.1 mg/ml systems to the skin.

Leachman et al. (Molecular Therapy, vol. 18 no. 2, 442-446 February 2010) relates to a phase Ib clinical trial for treatment of a rare skin disorder pachyonychia congenita (PC), an autosomal dominant syndrome that includes a disabling plantar keratoderma, utilizing the first short-interfering RNA (siRNA)-based therapeutic for skin. This siRNA, called TD101, specifically and potently targets the keratin 6a (K6a) N171K mutant mRNA without affecting wild-type K6a mRNA.

Zheng et al. (PNAS, Jul. 24, 2012, vol. 109, no. 30, 11975-11980) show that spherical nucleic acid nanoparticle conjugates (SNA-NCs), gold cores surrounded by a dense shell of highly oriented, covalently immobilized siRNA, freely penetrate almost 100% of keratinocytes in vitro, mouse skin, and human epidermis within hours after application. Zheng et al. demonstrated that a single application of 25 nM epidermal growth factor receptor (EGFR) SNA-NCs for 60 h demonstrate effective gene knockdown in human skin. A similar dosage may be contemplated for CRISPR Cas immobilized in SNA-NCs for administration to the skin.

Cancer

In some embodiments, the systems and methods are used for the treatment, prophylaxis or diagnosis of cancer. The target is preferably one or more of the FAS, BID, CTLA4, PDCD1, CBLB, PTPN6, TRAC or TRBC genes. The cancer may be one or more of lymphoma, chronic lymphocytic leukemia (CLL), B cell acute lymphocytic leukemia (B-ALL), acute lymphoblastic leukemia, acute myeloid leukemia, non-Hodgkin's lymphoma (NHL), diffuse large cell lymphoma (DLCL), multiple myeloma, renal cell carcinoma (RCC), neuroblastoma, colorectal cancer, breast cancer, ovarian cancer, melanoma, sarcoma, prostate cancer, lung cancer, esophageal cancer, hepatocellular carcinoma, pancreatic cancer, astrocytoma, mesothelioma, head and neck cancer, and medulloblastoma. This may be implemented with engineered chimeric antigen receptor (CAR) T cell. This is described in WO2015161276, the disclosure of which is hereby incorporated by reference and described herein below.

Target genes suitable for the treatment or prophylaxis of cancer may include, in some embodiments, those described in WO2015048577 the disclosure of which is hereby incorporated by reference.

Usher Syndrome or Retinitis Pigmentosa-39

In some embodiments, the treatment, prophylaxis or diagnosis of Usher Syndrome or retinitis pigmentosa-39 is provided. The target is preferably the USH2A gene. In some embodiments, correction of a G deletion at position 2299 (2299delG) is provided. This is described in WO2015134812A1, the disclosure of which is hereby incorporated by reference.

Autoimmune and Inflammatory Disorders

In some embodiments, autoimmune and inflammatory disorders are treated. These include Multiple Sclerosis (MS) or Rheumatoid Arthritis (RA), for example.

Cystic Fibrosis (CF)

In some embodiments, the treatment, prophylaxis or diagnosis of cystic fibrosis is provided. The target is preferably the SCNN1A or the CFTR gene. This is described in WO2015157070, the disclosure of which is hereby incorporated by reference.

Schwank et al. (Cell Stem Cell, 13:653-58, 2013) used CRISPR-Cas9 to correct a defect associated with cystic fibrosis in human stem cells. The team's target was the gene for an ion channel, cystic fibrosis transmembrane conductor receptor (CFTR). A deletion in CFTR causes the protein to misfold in cystic fibrosis patients. Using cultured intestinal stem cells developed from cell samples from two children with cystic fibrosis, Schwank et al. were able to correct the defect using CRISPR along with a donor plasmid containing the reparative sequence to be inserted. The researchers then grew the cells into intestinal "organoids," or miniature guts, and showed that they functioned normally. In this case, about half of clonal organoids underwent the proper genetic correction.

In some embodiments, Cystic fibrosis is treated, for example. Delivery to the lungs is therefore preferred. The F508 mutation (delta-F508, full name CFTRAF508 or F508del-CFTR) is preferably corrected. In some embodiments, the targets may be ABCC7, CF or MRP7.

Duchenne's Muscular Dystrophy

Duchenne's muscular dystrophy (DMD) is a recessive, sex-linked muscle wasting disease that affects approximately 1 in 5000 males at birth. Mutations of the dystrophin gene result in an absence of dystrophin in skeletal muscle, where it normally functions to connect the cytoskeleton of the muscle fiber to the basal lamina. The absence of dystrophin caused be these mutations results in excessive calcium entry into the soma which causes the mitochondria to rupture, destroying the cell. Current treatments are focused on easing the symptoms of DMD, and the average life expectancy is approximately 26 years.

CRISPR/Cas9 efficacy as a treatment for certain types of DMD has been demonstrated in mouse models. In one such study, the muscular dystrophy phenotype was partially corrected in the mouse by knocking-out a mutant exon resulting in a functional protein (see Nelson et al. (2016) Science, Long et al. (2016) Science, and Tabebordbar et al. (2016) Science).

In some embodiments, DMD is treated. In some embodiments, delivery is to the muscle by injection.

Glycogen Storage Diseases, Including 1a

Glycogen Storage Disease 1a is a genetic disease resulting from deficiency of the enzyme glucose-6-phosphatase. The deficiency impairs the ability of the liver to produce free glucose from glycogen and from gluconeogenesis. In some embodiments, the gene encoding the glucose-6-phosphatase enzyme is targeted. In some embodiments, Glycogen Storage Disease 1a is treated. In some embodiments, delivery is to the liver by encapsulation of the Type V effector (in protein or mRNA form) in a lipid particle, such as an LNP.

In some embodiments, Glycogen Storage Diseases, including 1a, are targeted and preferably treated, for example by targeting polynucleotides associated with the condition/disease/infection. The associated polynucleotides include DNA, which may include genes (where genes include any coding sequence and regulatory elements such as enhancers or promoters). In some embodiments, the associated polynucleotides may include the SLC2A2, GLUT2, G6PC, G6PT, G6PT1, GAA, LAMP2, LAMPB, AGL, GDE, GBE1, GYS2, PYGL, or PFKM genes.

Hurler Syndrome

Hurler syndrome, also known as mucopolysaccharidosis type I (MPS I), Hurler's disease, is a genetic disorder that results in the buildup of glycosaminoglycans (formerly known as mucopolysaccharides) due to a deficiency of alpha-L iduronidase, an enzyme responsible for the degradation of mucopolysaccharides in lysosomes. Hurler syndrome is often classified as a lysosomal storage disease, and is clinically related to Hunter Syndrome. Hunter syndrome is X-linked while Hurler syndrome is autosomal recessive. MPS I is divided into three subtypes based on severity of symptoms. All three types result from an absence of, or insufficient levels of, the enzyme α-L-iduronidase. MPS I H or Hurler syndrome is the most severe of the MPS I subtypes. The other two types are MPS I S or Scheie syndrome and MPS I H-S or Hurler-Scheie syndrome. Children born to an MPS I parent carry a defective IDUA gene, which has been mapped to the 4p16.3 site on chromosome 4. The gene is named IDUA because of its iduronidase enzyme protein product. As of 2001, 52 different mutations in the IDUA gene have been shown to cause Hurler syndrome. Successful treatment of the mouse, dog, and cat models of MPS I by delivery of the iduronidase gene through retroviral, lentiviral, AAV, and even nonviral vectors.

In some embodiments, the α-L-iduronidase gene is targeted and a repair template preferably provided.

HIV and AIDS

In some embodiments, the treatment, prophylaxis or diagnosis of HIV and AIDS is provided. The target is preferably the CCR5 gene in HIV. This is described in WO2015148670A1, the disclosure of which is hereby incorporated by reference.

Beta Thalassaemia

In some embodiments, the treatment, prophylaxis or diagnosis of Beta Thalassaemia is provided. The target is preferably the BCL11A gene. This is described in WO2015148860, the disclosure of which is hereby incorporated by reference.

Sickle Cell Disease (SCD)

In some embodiments, the treatment, prophylaxis or diagnosis of Sickle Cell Disease (SCD) is provided. The target is preferably the HBB or BCL11A gene. This is described in WO2015148863, the disclosure of which is hereby incorporated by reference.

Herpes Simplex Virus 1 and 2

Herpesviridae are a family of viruses composed of linear double-stranded DNA genomes with 75-200 genes. For the purposes of gene editing, the most commonly studied family member is Herpes Simplex Virus-1 (HSV-1), a virus which has a distinct number of advantages over other viral vectors (reviewed in Vannuci et al. (2003)). Thus, in some embodiments, the viral vector is an HSV viral vector. In some embodiments, the HSV viral vector is HSV-1.

HSV-1 has a large genome of approximately 152 kb of double stranded DNA. This genome comprises of more than 80 genes, many of which can be replaced or removed, allowing a gene insert of between 30-150 kb. The viral vectors derived from HSV-1 are generally separated into 3 groups: replication-competent attenuated vectors, replication-incompetent recombinant vectors, and defective helper-dependent vectors known as amplicons. Gene transfer using HSV-1 as a vector has been demonstrated previously, for instance for the treatment of neuropathic pain (see, e.g., Wolfe et al. (2009) Gene Ther) and rheumatoid arthritis (see e.g., Burton et al. (2001) Stem Cells).

Thus, in some embodiments, the viral vector is an HSV viral vector. In some embodiments, the HSV viral vector is HSV-1. In some embodiments, the vector is used for delivery of one or more CRISPR components. It may be particularly useful for delivery of the Type V effector and one or more guide RNAs, for example 2 or more, 3 or more, or 4 or more guide RNAs. In some embodiments, the vector is theretofore useful in a multiplex system. In some embodiments, this delivery is for the treatment of treatment of neuropathic pain or rheumatoid arthritis.

In some embodiments, the treatment, prophylaxis or diagnosis of HSV-1 (Herpes Simplex Virus 1) is provided. The target is preferably the UL19, UL30, UL48 or UL50 gene in HSV-1. This is described in WO2015153789, the disclosure of which is hereby incorporated by reference.

In other embodiments, the treatment, prophylaxis or diagnosis of HSV-2 (Herpes Simplex Virus 2) is provided. The target is preferably the UL19, UL30, UL48 or UL50 gene in HSV-2. This is described in WO2015153791, the disclosure of which is hereby incorporated by reference.

In some embodiments, the treatment, prophylaxis or diagnosis of Primary Open Angle Glaucoma (POAG) is provided. The target is preferably the MYOC gene. This is described in WO2015153780, the disclosure of which is hereby incorporated by reference.

Adoptive Cell Therapies

The present invention also contemplates use of the system described herein to modify cells for adoptive therapies. Aspects of the invention accordingly involve the adoptive transfer of immune system cells, such as T cells, specific for selected antigens, such as tumor associated antigens (see Maus et al., 2014, Adoptive Immunotherapy for Cancer or Viruses, Annual Review of Immunology, Vol. 32: 189-225; Rosenberg and Restifo, 2015, Adoptive cell transfer as personalized immunotherapy for human cancer, Science Vol. 348 no. 6230 pp. 62-68; and, Restifo et al., 2015, Adoptive immunotherapy for cancer: harnessing the T cell response. Nat. Rev. Immunol. 12(4): 269-281; and Jenson and Riddell, 2014, Design and implementation of adoptive therapy with viral chimeric antigen receptor-modified T cells. Immunol Rev. 257(1): 127-144). Various strategies may for example be employed to genetically modify T cells by altering the specificity of the T cell receptor (TCR) for example by introducing new TCR α and β chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088,379).

In some embodiments, the systems herein may be used for adding one or more donor polynucleotides encoding antigen receptors, such as TCR. The systems may be used for adding one or more donor polynucleotides encoding a TCR to a cell. In some examples, the systems may be used for adding one or more polynucleotides encoding an engineered, e.g., chimeric antigen receptors to a cell.

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004,811; 6,284,240; 6,392,013; 6,410,014; 6,753,162; 8,211,422; and, PCT Publication WO9215322). Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8α hinge domain and a CD8α transmembrane domain, to the transmembrane and intracellular signaling domains of either CD3ζ or FcRγ (scFv-CD3ζ or scFv-FcRγ; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761). Third-generation CARs include a combination of costimulatory endodomains, such a CD3ζ-chain, CD97, GDI la-CD18, CD2, ICOS, CD27, CD154, CDS, OX40, 4-1BB, or CD28 signaling domains (for example scFv-CD28-4-1BB-CD3ζ or scFv-CD28-OX40-CD3ζ; see U.S. Pat. Nos. 8,906,682; 8,399,645; 5,686,281; PCT Publication No. WO2014134165; PCT Publication No. WO2012079000). Alternatively, costimulation may be orchestrated by expressing CARs in antigen-specific T cells, chosen so as to be activated and expanded following engagement of their native αβTCR, for example by antigen on professional antigen-presenting cells, with attendant costimulation. In addition, additional engineered receptors may be provided on the immunoresponsive cells, for example to improve targeting of a T-cell attack and/or minimize side effects.

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using 2nd generation antigen-specific CARs signaling through CD3ζ and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with γ-irradiated activating and propagating cells (AaPC), which co-express the cancer antigen and co-stimulatory molecules. The engineered CAR T-cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to threat tumor xenografts.

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoreponsive cell, thereby treating or preventing the disease (such as a neoplasia, a pathogen infection, an autoimmune disorder, or an allogeneic transplant reaction). Dosing in CAR T cell therapies may for example involve administration of from 106 to 109 cells/kg, with or without a course of lymphodepletion, for example with cyclophosphamide.

In one embodiment, the treatment can be administrated into patients undergoing an immunosuppressive treatment. The cells or population of cells, may be made resistant to at least one immunosuppressive agent due to the inactivation of a gene encoding a receptor for such immunosuppressive agent. Not being bound by a theory, the immunosuppressive treatment should help the selection and expansion of the immunoresponsive or T cells according to the invention within the patient.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of 104-109 cells per kg body weight, preferably 105 to 106 cells/kg body weight including all integer values of cell numbers within those ranges.

Dosing in CAR T cell therapies may for example involve administration of from 106 to 109 cells/kg, with or without a course of lymphodepletion, for example with cyclophosphamide. The cells or population of cells can be administrated in one or more doses. In another embodiment, the effective amount of cells are administrated as a single dose. In another embodiment, the effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells are administrated parenterally. The administration can be an intravenous administration. The administration can be directly done by injection within a tumor.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation (Greco, et al., Improving the safety of cell therapy with the TK-suicide gene. Front. Pharmacol. 2015; 6: 95). In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-1683; Sadelain M, The New England Journal of Medicine 2011; 365:1735-173; Ramos et al., Stem Cells 28(6):1107-15 (2010)).

In a further refinement of adoptive therapies, genome editing with a system as described herein may be used to tailor immunoresponsive cells to alternative implementations, for example providing edited CAR T cells (see Poirot et al., 2015, Multiplex genome edited T-cell manufacturing platform for "off-the-shelf" adoptive T-cell immunotherapies, Cancer Res 75 (18): 3853). For example, immunoresponsive cells may be edited to delete expression of some or all of the class of HLA type II and/or type I molecules, or to knockout selected genes that may inhibit the desired immune response, such as the PD1 gene.

Cells may be edited using any system and method of use thereof as described herein. systems may be delivered to an immune cell by any method described herein. In preferred embodiments, cells are edited ex vivo and transferred to a subject in need thereof. Immunoresponsive cells, CAR T cells or any cells used for adoptive cell transfer may be edited. Editing may be performed to eliminate potential alloreactive T-cell receptors (TCR), disrupt the target of a chemotherapeutic agent, block an immune checkpoint, activate a T cell, and/or increase the differentiation and/or proliferation of functionally exhausted or dysfunctional CD8+ T-cells (see PCT Patent Publications: WO2013176915, WO2014059173, WO2014172606, WO2014184744, and WO2014191128). Editing may result in inactivation of a gene.

By inactivating a gene it is intended that the gene of interest is not expressed in a functional protein form. In a particular embodiment, the system specifically catalyzes cleavage in one targeted gene thereby inactivating said targeted gene. The nucleic acid strand breaks caused are commonly repaired through the distinct mechanisms of homologous recombination or non-homologous end joining (NHEJ). However, NHEJ is an imperfect repair process that often results in changes to the DNA sequence at the site of the cleavage. Repair via non-homologous end joining (NHEJ) often results in small insertions or deletions (Indel) and can be used for the creation of specific gene knockouts. Cells in which a cleavage induced mutagenesis event has occurred can be identified and/or selected by well-known methods in the art.

T cell receptors (TCR) are cell surface receptors that participate in the activation of T cells in response to the presentation of antigen. The TCR is generally made from two chains, α and β, which assemble to form a heterodimer and associates with the CD3-transducing subunits to form the T cell receptor complex present on the cell surface. Each α and β chain of the TCR consists of an immunoglobulin-like N-terminal variable (V) and constant (C) region, a hydrophobic transmembrane domain, and a short cytoplasmic region. As for immunoglobulin molecules, the variable region of the α and β chains are generated by V(D)J recombination, creating a large diversity of antigen specificities within the population of T cells. However, in contrast to immunoglobulins that recognize intact antigen, T cells are activated by processed peptide fragments in association with an MHC molecule, introducing an extra dimension to antigen recognition by T cells, known as MHC restriction. Recognition of MHC disparities between the donor and recipient through the T cell receptor leads to T cell proliferation and the potential development of graft versus host disease (GVHD). The inactivation of TCRα or TCRβ can result in the elimination of the TCR from the surface of T cells preventing recognition of alloantigen and thus GVHD. However, TCR disruption generally results in the elimination of the CD3 signaling component and alters the means of further T cell expansion.

Allogeneic cells are rapidly rejected by the host immune system. It has been demonstrated that, allogeneic leukocytes present in non-irradiated blood products will persist for no more than 5 to 6 days (Boni, Muranski et al. 2008 Blood 1; 112(12):4746-54). Thus, to prevent rejection of allogeneic cells, the host's immune system usually has to be suppressed to some extent. However, in the case of adoptive cell transfer the use of immunosuppressive drugs also have a detrimental effect on the introduced therapeutic T cells. Therefore, to effectively use an adoptive immunotherapy approach in these conditions, the introduced cells would need to be resistant to the immunosuppressive treatment. Thus, in a particular embodiment, the present invention further comprises a step of modifying T cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to T cells for immunotherapy by inactivating the target of the immunosuppressive agent in T cells. As non-limiting examples, targets for an immunosuppressive agent can be a receptor for an immunosuppressive agent such as: CD52, glucocorticoid receptor (GR), a FKBP family gene member and a cyclophilin family gene member.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson H A, et al., SHP-1: the next checkpoint target for cancer immunotherapy? Biochem Soc Trans. 2016 Apr. 15; 44(2):356-62). SHP-1 is a widely expressed inhibitory protein tyrosine phosphatase (PTP). In T-cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

WO2014172606 relates to the use of MT1 and/or MT1 inhibitors to increase proliferation and/or activity of exhausted CD8+ T-cells and to decrease CD8+ T-cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFRBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SHP-1 or TIM-3. In preferred embodiments, the gene locus involved in the expression of PD-1 or CTLA-4 genes is targeted. In other preferred embodiments, combinations of genes are targeted, such as but not limited to PD-1 and TIGIT.

In other embodiments, at least two genes are edited. Pairs of genes may include, but are not limited to PD1 and TCRα, PD1 and TCRβ, CTLA-4 and TCRα, CTLA-4 and TCRβ, LAG3 and TCRα, LAG3 and TCRβ, Tim3 and TCRα, Tim3 and TCRβ, BTLA and TCRα, BTLA and TCRβ, BY55 and TCRα, BY55 and TCRβ, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ.

Whether prior to or after genetic modification of the T cells, the T cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. T cells can be expanded in vitro or in vivo.

The practice of the present invention employs, unless otherwise indicated, conventional techniques of immunology, biochemistry, chemistry, molecular biology, microbiology, cell biology, genomics and recombinant DNA, which are within the skill of the art. See MOLECULAR CLONING: A LABORATORY MANUAL, 2nd edition (1989) (Sambrook, Fritsch and Maniatis); MOLECULAR CLONING: A LABORATORY MANUAL, 4th edition (2012) (Green and Sambrook); CURRENT PROTOCOLS IN MOLECULAR BIOLOGY (1987) (F. M. Ausubel, et al. eds.); the series METHODS IN ENZYMOLOGY (Academic Press, Inc.); PCR 2: A PRACTICAL APPROACH (1995) (M. J. MacPherson, B. D. Hames and G. R. Taylor eds.); ANTIBODIES, A LABORATORY MANUAL (1988) (Harlow and Lane, eds.); ANTIBODIES A LABORATORY MANUAL, 2nd edition (2013) (E. A. Greenfield ed.); and ANIMAL CELL CULTURE (1987) (R. I. Freshney, ed.).

The practice of the present invention employs, unless otherwise indicated, conventional techniques for generation of genetically modified mice. See Marten H. Hofker and Jan van Deursen, TRANSGENIC MOUSE METHODS AND PROTOCOLS, 2nd edition (2011).

In some embodiments, the invention described herein relates to a method for adoptive immunotherapy, in which T cells are edited ex vivo by CRISPR to modulate at least one gene and subsequently administered to a patient in need thereof. In some embodiments, the CRISPR editing comprising knocking-out or knocking-down the expression of at least one target gene in the edited T cells. In some embodiments, in addition to modulating the target gene, the T cells are also edited ex vivo by CRISPR to (1) knock-in an exogenous gene encoding a chimeric antigen receptor (CAR) or a T-cell receptor (TCR), (2) knock-out or knock-down expression of an immune checkpoint receptor, (3) knock-out or knock-down expression of an endogenous TCR, (4) knock-out or knock-down expression of a human leukocyte antigen class I (HLA-I) proteins, and/or (5) knock-out or knock-down expression of an endogenous gene encoding an antigen targeted by an exogenous CAR or TCR.

In some embodiments, the T cells are contacted ex vivo with an adeno-associated virus (AAV) vector encoding a CRISPR effector protein, and a guide molecule comprising a guide sequence hybridizable to a target sequence, a tracr mate sequence, and a tracr sequence hybridizable to the tracr mate sequence. In some embodiments, the T cells are contacted ex vivo (e.g., by electroporation) with a ribonucleoprotein (RNP) comprising a CRISPR effector protein complexed with a guide molecule, wherein the guide molecule comprising a guide sequence hybridizable to a target sequence, a tracr mate sequence, and a tracr sequence hybridizable to the tracr mate sequence. See Rupp et al., Scientific Reports 7:737 (2017); Liu et al., Cell Research 27:154-157 (2017). In some embodiments, the T cells are contacted ex vivo (e.g., by electroporation) with an mRNA encoding a CRISPR effector protein, and a guide molecule comprising a guide sequence hybridizable to a target sequence, a tracr mate sequence, and a tracr sequence hybridizable to the tracr mate sequence. See Eyquem et al., Nature 543:113-117 (2017). In some embodiments, the T cells are not contacted ex vivo with a lentivirus or retrovirus vector.

In some embodiments, the method comprises editing T cells ex vivo by CRISPR to knock-in an exogenous gene encoding a CAR, thereby allowing the edited T cells to recognize cancer cells based on the expression of specific proteins located on the cell surface. In some embodiments, T cells are edited ex vivo by CRISPR to knock-in an exogenous gene encoding a TCR, thereby allowing the edited T cells to recognize proteins derived from either the surface or inside of the cancer cells. In some embodiments, the method comprising providing an exogenous CAR-encoding or TCR-encoding sequence as a donor sequence, which can be integrated by homology-directed repair (HDR) into a genomic locus targeted by a CRISPR guide sequence. In some embodiments, targeting the exogenous CAR or TCR to an endogenous TCR a constant (TRAC) locus can reduce tonic CAR signaling and facilitate effective internalization and re-expression of the CAR following single or repeated exposure to antigen, thereby delaying effector T-cell differentiation and exhaustion. See Eyquem et al., Nature 543:113-117 (2017).

In some embodiments, the method comprises editing T cells ex vivo by CRISPR to block one or more immune checkpoint receptors to reduce immunosuppression by cancer cells. In some embodiments, T cells are edited ex vivo by CRISPR to knock-out or knock-down an endogenous gene involved in the programmed death-1 (PD-1) signaling pathway, such as PD-1 and PD-L1. In some embodiments, T cells are edited ex vivo by CRISPR to mutate the Pdcd1 locus or the CD274 locus. In some embodiments, T cells are edited ex vivo by CRISPR using one or more guide sequences targeting the first exon of PD-1. See Rupp et al., Scientific Reports 7:737 (2017); Liu et al., Cell Research 27:154-157 (2017).

In some embodiments, the method comprises editing T cells ex vivo by CRISPR to eliminate potential alloreactive TCRs to allow allogeneic adoptive transfer. In some embodiments, T cells are edited ex vivo by CRISPR to knock-out or knock-down an endogenous gene encoding a TCR (e.g., an αβ TCR) to avoid graft-versus-host-disease (GVHD). In some embodiments, T cells are edited ex vivo by CRISPR to mutate the TRAC locus. In some embodiments, T cells are edited ex vivo by CRISPR using one or more guide sequences targeting the first exon of TRAC. See Liu et al., Cell Research 27:154-157 (2017). In some embodiments, the method comprises use of CRISPR to knock-in an exogenous gene encoding a CAR or a TCR into the TRAC locus, while simultaneously knocking-out the endogenous TCR (e.g., with a donor sequence encoding a self-cleaving P2A peptide following the CAR cDNA). See Eyquem et al., Nature 543:113-117 (2017). In some embodiments, the exogenous gene comprises a promoter-less CAR-encoding or TCR-encoding sequence which is inserted operably downstream of an endogenous TCR promoter.

In some embodiments, the method comprises editing T cells ex vivo by CRISPR to knock-out or knock-down an endogenous gene encoding an HLA-I protein to minimize immunogenicity of the edited T cells. In some embodiments, T cells are edited ex vivo by CRISPR to mutate the beta-2 microglobulin (B2M) locus. In some embodiments, T cells are edited ex vivo by CRISPR using one or more guide sequences targeting the first exon of B2M. See Liu et al., Cell Research 27:154-157 (2017). In some embodiments, the method comprises use of CRISPR to knock-in an exogenous gene encoding a CAR or a TCR into the B2M locus, while simultaneously knocking-out the endogenous B2M (e.g., with a donor sequence encoding a self-cleaving P2A peptide following the CAR cDNA). See Eyquem et al., Nature 543:113-117 (2017). In some embodiments, the exogenous gene comprises a promoter-less CAR-encoding or TCR-encoding sequence which is inserted operably downstream of an endogenous B2M promoter.

In some embodiments, the method comprises editing T cells ex vivo by CRISPR to knock-out or knock-down an endogenous gene encoding an antigen targeted by an exogenous CAR or TCR. In some embodiments, the T cells are edited ex vivo by CRISPR to knock-out or knock-down the expression of a tumor antigen selected from human telomerase reverse transcriptase (hTERT), survivin, mouse double minute 2 homolog (MDM2), cytochrome P450 1B 1 (CYP1B), HER2/neu, Wilms' tumor gene 1 (WT1), livin, alphafetoprotein (AFP), carcinoembryonic antigen (CEA), mucin 16 (MUC16), MUC1, prostate-specific membrane antigen (PSMA), p53 or cyclin (DI) (see WO2016/011210). In some embodiments, the T cells are edited ex vivo by CRISPR to knock-out or knock-down the expression of an antigen selected from B cell maturation antigen (BCMA), transmembrane activator and CAML Interactor (TACT), or B-cell activating factor receptor (BAFF-R), CD38, CD138, CS-1, CD33, CD26, CD30, CD53, CD92, CD100, CD148, CD150, CD200, CD261, CD262, or CD362 (see WO2017/011804).

Gene Drives

The present invention also contemplates use of the system described herein to provide RNA-guided gene drives, for example in systems analogous to gene drives described in PCT Patent Publication WO 2015/105928. Systems of this kind may for example provide methods for altering eukaryotic germline cells, by introducing into the germline cell a nucleic acid sequence encoding an RNA-guided DNA nuclease and one or more guide RNAs. The guide RNAs may be designed to be complementary to one or more target locations on genomic DNA of the germline cell. The nucleic acid sequence encoding the RNA guided DNA nuclease and the nucleic acid sequence encoding the guide RNAs may be provided on constructs between flanking sequences, with promoters arranged such that the germline cell may express the RNA guided DNA nuclease and the guide RNAs, together with any desired cargo-encoding sequences that are also situated between the flanking sequences. The flanking sequences will typically include a sequence which is identical to a corresponding sequence on a selected target chromosome, so that the flanking sequences work with the components encoded by the construct to facilitate insertion of the foreign nucleic acid construct sequences into genomic DNA at a target cut site by mechanisms such as homologous recombination, to render the germline cell homozygous for the foreign nucleic acid sequence. In this way, gene-drive systems are capable of introgressing desired cargo genes throughout a breeding population (Gantz et al., 2015, Highly efficient Cas9-mediated gene drive for population modification of the malaria vector mosquito *Anopheles stephensi*, PNAS 2015, published ahead of print Nov. 23, 2015, doi: 10.1073/pnas.1521077112; Esvelt et al., 2014, Concerning RNA-guided gene drives for the alteration of wild populations eLife 2014; 3:e03401). In select embodiments, target sequences may be selected which have few potential off-target sites in a genome. Targeting multiple sites within a target locus, using multiple guide RNAs, may increase the cutting frequency and hinder the evolution of drive resistant alleles. Truncated guide RNAs may reduce off-target cutting. Paired nickases may be used instead of a single nuclease, to further increase specificity. Gene drive constructs may include cargo sequences encoding transcriptional regulators, for example to activate homologous recombination genes and/or repress non-homologous end-joining. Target sites may be chosen within an essential gene, so that non-homologous end-joining events may cause lethality rather than creating a drive-resistant allele. The gene drive constructs can be engineered to function in a range of hosts at a range of temperatures (Cho et al. 2013, Rapid and Tunable Control of Protein Stability in *Caenorhabditis elegans* Using a Small Molecule, PLoS ONE 8(8): e72393. doi:10.1371/journal.pone.0072393).

Xenotransplantation

The present invention also contemplates use of the system described hereinto provide RNA-guided DNA nucleases adapted to be used to provide modified tissues for transplantation. For example, RNA-guided DNA nucleases may be used to knockout, knockdown or disrupt selected genes in an animal, such as a transgenic pig (such as the human heme oxygenase-1 transgenic pig line), for example by disrupting expression of genes that encode epitopes recognized by the human immune system, i.e. xenoantigen genes. Candidate porcine genes for disruption may for example include a(1, 3)-galactosyltransferase and cytidine monophosphate-N-acetylneuraminic acid hydroxylase genes (see PCT Patent Publication WO 2014/066505). In addition, genes encoding endogenous retroviruses may be disrupted, for example the genes encoding all porcine endogenous retroviruses (see Yang et al., 2015, Genome-wide inactivation of porcine endogenous retroviruses (PERVs), Science 27 Nov. 2015: Vol. 350 no. 6264 pp. 1101-1104). In addition, RNA-guided DNA nucleases may be used to target a site for integration of additional genes in xenotransplant donor animals, such as a human CD55 gene to improve protection against hyper-acute rejection.

General Gene Therapy Considerations

Examples of disease-associated genes and polynucleotides amd disease specific information is available from McKusick-Nathans Institute of Genetic Medicine, Johns Hopkins University (Baltimore, Md.) and National Center for Biotechnology Information, National Library of Medicine (Bethesda, Md.), available on the World Wide Web.

Mutations in these genes and pathways can result in production of improper proteins or proteins in improper amounts which affect function. Further examples of genes, diseases and proteins are hereby incorporated by reference from U.S. Provisional application 61/736,527 filed Dec. 12, 2012. Such genes, proteins and pathways may be the target polynucleotide of a CRISPR complex of the present invention. Examples of disease-associated genes and polynucleotides are listed in Tables 8 and 9. Examples of signaling biochemical pathway-associated genes and polynucleotides are listed in Table 10.

TABLE 8

| DISEASE/DISORDERS | GENE(S) |
|---|---|
| Neoplasia | PTEN; ATM; ATR; EGFR; ERBB2; ERBB3; ERBB4; Notch1; Notch2; Notch3; Notch4; AKT; AKT2; AKT3; HIF; HIF1a; HIF3a; Met; HRG; Bcl2; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bcl2; caspases family (9 members: 1, 2, 3, 4, 6, 7, 8, 9, 12); Kras; Apc |
| Age-related Macular Degeneration | Abcr; Ccl2; Cc2; cp (ceruloplasmin); Timp3; cathepsinD; Vldlr; Ccr2 |
| Schizophrenia | Neuregulin1 (Nrg1); Erb4 (receptor for Neuregulin); Complexin1 (Cplx1); Tph1 Tryptophan hydroxylase; Tph2 Tryptophan hydroxylase 2; Neurexin 1; GSK3; GSK3a; GSK3b |
| Disorders | 5-HTT (Slc6a4); COMT; DRD (Drd1a); SLC6A3; DAOA; DTNBP1; Dao (Dao1) |
| Trinucleotide Repeat Disorders | HTT (Huntington's Dx); SBMA/SMAX1/AR (Kennedy's Dx); FXN/X25 (Friedrich's Ataxia); ATX3 (Machado-Joseph's Dx); ATXN1 and ATXN2 (spinocerebellar ataxias); DMPK (myotonic dystrophy); Atrophin-1 and Atn1 (DRPLA Dx); CBP (Creb-BP-global instability); VLDLR (Alzheimer's); Atxn7; Atxn10 |
| Fragile X Syndrome | FMR2; FXR1; FXR2; mGLUR5 |
| Secretase Related Disorders | APH-1 (alpha and beta); Presenilin (Psen1); nicastrin (Ncstn); PEN-2 |
| Others | Nos1; Parp1; Nat1; Nat2 |
| Prion-related disorders | Prp |
| ALS | SOD1; ALS2; STEX; FUS; TARDBP; VEGF (VEGF-a; VEGF-b; VEGF-c) |
| Drug addiction | Prkce (alcohol); Drd2; Drd4; ABAT (alcohol); GRIA2; Grm5; Grin1; Htr1b; Grin2a; Drd3; Pdyn; Gria1 (alcohol) |
| Autism | Mecp2; BZRAP1; MDGA2; Sema5A; Neurexin 1; Fragile X (FMR2 (AFF2); FXR1; FXR2; Mglur5) |

TABLE 8-continued

| DISEASE/DISORDERS | GENE(S) |
| --- | --- |
| Alzheimer's Disease | E1; CHIP; UCH; UBB; Tau; LRP; PICALM; Clusterin; PS1; SORL1; CR1; Vldlr; Uba1; Uba3; CHIP28 (Aqp1, Aquaporin 1); Uchl1; Uchl3; APP |
| Inflammation | IL-10; IL-1 (IL-1a; IL-1b); IL-13; IL-17 (IL-17a (CTLA8); IL-17b; IL-17c; IL-17d; IL-17f); Il-23; Cx3cr1; ptpn22; TNFa; NOD2/CARD15 for IBD; IL-6; IL-12 (IL-12a; IL-12b); CTLA4; Cx3cl1 |
| Parkinson's Disease | x-Synuclein; DJ-1; LRRK2; Parkin; PINK1 |

TABLE 9

| | |
| --- | --- |
| Blood and coagulation diseases and disorders | Anemia (CDAN1, CDA1, RPS19, DBA, PKLR, PK1, NT5C3, UMPH1, PSN1, RHAG, RH50A, NRAMP2, SPTB, ALAS2, ANH1, ASB, ABCB7, ABC7, ASAT); Bare lymphocyte syndrome (TAPBP, TPSN, TAP2, ABCB3, PSF2, RING11, MHC2TA, C2TA, RFX5, RFXAP, RFX5), Bleeding disorders (TBXA2R, P2RX1, P2X1); Factor H and factor H-like 1 (HF1, CFH, HUS); Factor V and factor VIII (MCFD2); Factor VII deficiency (F7); Factor X deficiency (F10); Factor XI deficiency (F11); Factor XII deficiency (F12, HAF); Factor XIIIA deficiency (F13A1, F13A); Factor XIIIB deficiency (F13B); Fanconi anemia (FANCA, FACA, FA1, FA, FAA, FAAP95, FAAP90, FLJ34064, FANCB, FANCC, FACC, BRCA2, FANCD1, FANCD2, FANCD, FACD, FAD, FANCE, FACE, FANCF, XRCC9, FANCG, BRIP1, BACH1, FANCJ, PHF9, FANCL, FANCM, KIAA1596); Hemophagocytic lymphohistiocytosis disorders (PRF1, HPLH2, UNC13D, MUNC13-4, HPLH3, HLH3, FHL3); Hemophilia A (F8, F8C, HEMA); Hemophilia B (F9, HEMB), Hemorrhagic disorders (PI, ATT, F5); Leukocyde deficiencies and disorders (ITGB2, CD18, LCAMB, LAD, EIF2B1, EIF2BA, EIF2B2, EIF2B3, EIF2B5, LVWM, CACH, CLE, EIF2B4); Sickle cell anemia (HBB); Thalassemia (HBA2, HBB, HBD, LCRB, HBA1). |
| Cell dysregulation and oncology diseases and disorders | B-cell non-Hodgkin lymphoma (BCL7A, BCL7); Leukemia (TALI, TCL5, SCL, TAL2, FLT3, NBS1, NBS, ZNFN1A1, IK1, LYF1, HOXD4, HOX4B, BCR, CML, PHL, ALL, ARNT, KRAS2, RASK2, GMPS, AF10, ARHGEF12, LARG, KIAA0382, CALM, CLTH, CEBPA, CEBP, CHIC2, BTL, FLT3, KIT, PBT, LPP, NPM1, NUP214, D9546E, CAN, CAIN, RUNX1, CBFA2, AML1, WHSC1L1, NSD3, FLT3, AF1Q, NPM1, NUMA1, ZNF145, PLZF, PML, MYL, STAT5B, AF10, CALM, CLTH, ARL11, ARLTS1, P2RX7, P2X7, BCR, CML, PHL, ALL, GRAF, NF1, VRNF, WSS, NFNS, PTPN11, PTP2C, SHP2, NS1, BCL2, CCND1, PRAD1, BCL1, TCRA, GATA1, GF1, ERYF1, NFE1, ABL1, NQO1, DIA4, NMOR1, NUP214, D9S46E, CAN, CAIN). |
| Inflammation and immune related diseases and disorders | AIDS (KIR3DL1, NKAT3, NKB1, AMB11, KIR3DS1, IFNG, CXCL12, SDF1); Autoimmune lymphoproliferative syndrome (TNFRSF6, APT1, FAS, CD95, ALPS1A); Combined immunodeficiency, (IL2RG, SCIDX1, SCIDX, IMD4); HIV-1 (CCL5, SCYA5, D17S136E, TCP228), HIV susceptibility or infection (IL10, CSIF, CMKBR2, CCR2, CMKBR5, CCCKR5 (CCR5)); Immunodeficiencies (CD3E, CD3G, AICDA, AID, HIGM2, TNFRSF5, CD40, UNG, DGU, HIGM4, TNFSF5, CD40LG, HIGM1, IGM, FOXP3, IPEX, AIID, XPID, PIDX, TNFRSF14B, TACI); Inflammation (IL-10, IL-1 (IL-1a, IL-1b), IL-13, IL-17 (IL-17a (CTLA8), IL-17b, IL-17c, IL-17d, IL-17f), Il-23, Cx3cr1, ptpn22, TNFa, NOD2/CARD15 for IBD, IL-6, IL-12 (IL-12a, IL-12b), CTLA4, Cx3cl1); Severe combined immunodeficiencies (SCIDs)(JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4). |
| Metabolic, liver, kidney and protein diseases and disorders | Amyloid neuropathy (TTR, PALB); Amyloidosis (APOA1, APP, AAA, CVAP, AD1, GSN, FGA, LYZ, TTR, PALB); Cirrhosis (KRT18, KRT8, CIRH1A, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPB, AGL, GDE, GBE1, GYS2, PYGL, PFKM); Hepatic adenoma, 142330 (TCF1, HNF1A, MODY3), Hepatic failure, early onset, and neurologic disorder (SCOD1, SCO1), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5); Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD1, PKD2, PKD4, PKDTS, PRKCSH, G19P1, PCLD, SEC63). |
| Muscular/Skeletal diseases and disorders | Becker muscular dystrophy (DMD, BMD, MYF6), Duchenne Muscular Dystrophy (DMD, BMD); Emery-Dreifuss muscular dystrophy (LMNA, LMN1, EMD2, FPLD, CMD1A, HGPS, LGMD1B, LMNA, LMN1, EMD2, FPLD, CMD1A); Facioscapulohumeral muscular dystrophy (FSHMD1A, FSHD1A); Muscular dystrophy (FKRP, MDC1C, LGMD2I, LAMA2, LAMM, LARGE, KIAA0609, MDC1D, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1); Osteopetrosis (LRP5, BMND1, LRP7, LR3, OPPG, VBCH2, CLCN7, CLC7, OPTA2, OSTM1, GL, TCIRG1, TIRC7, OC116, OPTB1); Muscular atrophy (VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARD1). |
| Neurological and neuronal diseases and disorders | ALS (SOD1, ALS2, STEX, FUS, TARDBP, VEGF (VEGF-a, VEGF-b, VEGF-c); Alzheimer disease (APP, AAA, CVAP, AD1, APOE, AD2, PSEN2, AD4, STM2, APBB2, FE65L1, NOS3, PLAU, URK, ACE, DCP1, ACE1, MPO, PACIP1, PAXIP1L, PTIP, A2M, BLMH, BMH, PSEN1, AD3); Autism (Mecp2, BZRAP1, MDGA2, Sema5A, Neurexin 1, GLO1, MECP2, RTT, PPMX, MRX16, MRX79, NLGN3, NLGN4, KIAA1260, AUTSX2); Fragile X Syndrome (FMR2, FXRL FXR2, mGLUR5); Huntington's disease and disease like disorders (HD, IT15, PRNP, PRIP, JPH3, JP3, HDL2, TBP, SCA17); Parkinson disease (NR4A2, NURR1, NOT, TINUR, SNCAIP, TBP, SCA17, SNCA, NACP, PARK1, PARK4, DJI, PARK7, LRRK2, PARK8, PINK1, PARK6, UCHL1, PARK5, SNCA, NACP, PARK1, PARK4, PRKN, PARK2, PDJ, DBH, NDUFV2); Rett syndrome (MECP2, RTT, PPMX, MRX16, MRX79, CDKL5, STK9, MECP2, RTT, PPMX, MRX16, MRX79, x-Synuclein, DJ-1); Schizophrenia (Neuregulin1 (Nrg1), Erb4 (receptor for Neuregulin), Complexin1 (Cplx1), Tph1 Tryptophan hydroxylase, Tph2, Tryptophan hydroxylase 2, Neurexin 1, GSK3, GSK3a, GSK3b, 5-HTT (Slc6a4), COMT, DRD (Drd1a), SLC6A3, DAOA, DTNBP1, Dao (Dao1)); |

TABLE 9-continued

| | |
|---|---|
| | Secretase Related Disorders (APH-1 (alpha and beta), Presenilin (Psen1), nicastrin, (Ncstn), PEN-2, Nos1, Parp1, Nat1, Nat2); Trinucleotide Repeat Disorders (HTT (Huntington's Dx), SBMA/SMAXI/AR (Kennedy's Dx), FXN/X25 (Friedrich's Ataxia), ATX3 (Machado-Joseph's Dx), ATXN1 and ATXN2 (spinocerebellar ataxias), DMPK (myotonic dystrophy), Atrophin-1 and Atn1 (DRPLA Dx), CBP (Creb-BP-global instability), VLDLR (Alzheimer's), Atxn7, Atxn10). |
| Occular diseases and disorders | Age-related macular degeneration (Abcr, Ccl2, Cc2, cp (ceruloplasmin), Timp3, cathepsinD, Vldlr, Ccr2); Cataract (CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQP0, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1); Corneal clouding and dystrophy (APOAI, TGFBI, CSD2, CDGG1, CSD, BIGH3, CDG2, TACSTD2, TROP2, M1S1, VSX1, RINX, PPCD, PPD, KTCN, COL8A2, FECD, PPCD2, PIP5K3, CFD); Cornea plana congenital (KERA, CNA2); Glaucoma (MYOC, TIGR, GLC1A, JOAG, GPOA, OPTN, GLC1E, FIP2, HYPL, NRP, CYP1B1, GLC3A, OPA1, NTG, NPG, CYP1B1, GLC3A); Leber congenital amaurosis (CRB1, RP12, CRX, CORD2, CRD, RPGRIP1, LCA6, CORD9, RPE65, RP20, AIPL1, LCA4, GUCY2D, GUC2D, LCA1, CORD6, RDH12, LCA3); Macular dystrophy (ELOVL4, ADMD, STGD2, STGD3, RDS, RP7, PRPH2, PRPH, AVMD, AOFMD, VMD2). |

TABLE 10

| CELLULAR FUNCTION | GENES |
|---|---|
| PI3K/AKT Signaling | PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKN1B; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF1; IKBKG; RELB; DYRK1A; CDKN1A; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SGK; HSP90AA1; RPS6KB1 |
| ERK/MAPK Signaling | PRKCE; ITGAM; ITGA5; HSPB1; IRAK1; PRKAA2; EIF2AK2; RAC1; RAP1A; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2R1A; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRK1A; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAF; ATF4; PRKCA; SRF; STAT1; SGK |
| Glucocorticoid Receptor Signaling | RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKN1C; TRAF2; SERPINE1; NCOA3; MAPK14; TNF; RAF1; IKBKG; MAP3K7; CREBBP; CDKN1A; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MMP1; STAT1; IL6; HSP90AA1 |
| Axonal Guidance Signaling | PRKCE; ITGAM; ROCK1; ITGA5; CXCR4; ADAM12; IGF1; RAC1; RAP1A; EIF4E; PRKCZ; NRP1; NTRK2; ARHGEF7; SMO; ROCK2; MAPK1; PGF; RAC2; PTPN11; GNAS; AKT2; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GLI1; WNT5A; ADAM10; MAP2K1; PAK3; ITGB3; CDC42; VEGFA; ITGA2; EPHA8; CRKL; RND1; GSK3B; AKT3; PRKCA |
| Ephrin Receptor Signaling | PRKCE; ITGAM; ROCK1; ITGA5; CXCR4; IRAK1; PRKAA2; EIF2AK2; RAC1; RAP1A; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRK1A; ITGB1; MAP2K2; PAK4; AKT1; JAK2; STAT3; ADAM10; MAP2K1; PAK3; ITGB3; CDC42; VEGFA; ITGA2; |

TABLE 10-continued

| CELLULAR FUNCTION | GENES |
|---|---|
| | EPHA8; TTK; CSNK1A1; CRKL; BRAF; PTPN13; ATF4; AKT3; SGK |
| Actin Cytoskeleton Signaling | ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD; PRKAA1; MAPK9; CDK2; PIM1; PIK3C2A; ITGB7; PPP1CC; PXN; VIL2; RAF1; GSN; DYRK1A; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK |
| Huntington's Disease Signaling | PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKCI; HSPA5; REST; GNAQ; PIK3CB; PIK3C3; MAPK8; IGF1R; PRKD1; GNB2L1; BCL2L1; CAPN1; MAPK3; CASP8; HDAC2 ; HDAC7A; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3 |
| Apoptosis Signaling | PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRK1A; MAP2K2; CHUK; APAF1; MAP2K1; NFKB1; PAK3; LMNA; CASP2; BIRC2; TTK; CSNK1A1; BRAF; BAX; PRKCA; SGK; CASP3; BIRC3; PARP1 |
| B Cell Receptor Signaling | RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1 |
| Leukocyte Extravasation Signaling | ACTN4; CD44; PRKCE; ITGAM; ROCK1; CXCR4; CYBA; RAC1; RAP1A; PRKCZ; ROCK2; RAC2; PTPN11; MMP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; FUR; ITK; CRKL; VAV3; CTTN; PRKCA; MMP1; MMP9 |
| Integrin Signaling | ACTN4; ITGAM; ROCK1; ITGA5; RAC1; PTEN; RAP1A; TLN1; ARHGEF7; MAPK1; RAC2; CAPNS1; AKT2; CAPN2; PIK3CA; PTK2; PIK3CB; PIK3C3; MAPK8; CAV1; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3 |
| Acute Phase Response Signaling | IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; IL1R1; IL6 |
| PTEN Signaling | ITGAM; ITGA5; RAC1; PTEN; PRKCZ; BCL2L11; MAPK1; RAC2; AKT2; EGFR; IKBKB; CBL; PIK3CA; CDKN1B; PTK2; NFKB2; BCL2; PIK3CB; BCL2L1; MAPK3; ITGA1; KRAS; ITGB7; ILK; PDGFRB; INSR; RAF1; IKBKG; CASP9; CDKN1A; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3; RPS6KB1 |
| p53 Signaling | PTEN; EP300; BBC3; PCAF; FASN; BRCA1: GADD45A; BIRC5; AKT2; PIK3CA; CHEK1; TP53INP1; BCL2; PIK3CB; PIK3C3; MAPK8; THBS1; ATR; BCL2L1; E2F1; PMAIP1; CHEK2; TNFRSF10B; TP73; RB1; HDAC9; CDK2; PIK3C2A; MAPK14; TP53; LRDD; CDKN1A; HIPK2; AKT1; PIK3R1; RRM2B; APAF1; CTNNB1; SIRT1; CCND1; PRKDC; ATM; SFN; CDKN2A; JUN; SNAI2; GSK3B; BAX; AKT3 |

TABLE 10-continued

| CELLULAR FUNCTION | GENES |
|---|---|
| Aryl Hydrocarbon Receptor Signaling | HSPB1; EP300; FASN; TGM2; RXRA; MAPK1; NQO1; NCOR2; SP1; ARNT; CDKN1B; FOS; CHEK1; SMARCA4; NFKB2; MAPK8; ALDH1A1; ATR; E2F1; MAPK3; NRIP1; CHEK2; RELA; TP73; GS TP 1; RB1; SRC; CDK2; AHR; NFE2L2; NCOA3; TP53; TNF; CDKN1A; NCOA2; APAF1; NFKB1; CCND1; ATM; ESR1; CDKN2A; MYC; JUN; ESR2; BAX; IL6; CYP1B1; HSP90AA1 |
| Xenobiotic Metabolism Signaling | PRKCE; EP300; PRKCZ; RXRA; MAPK1; NQO1; NCOR2; PIK3CA; ARNT; PRKCI; NFKB2; CAMK2A; PIK3CB; PPP2R1A; PIK3C3; MAPK8; PRKD1; ALDH1A1; MAPK3; NRIP1; KRAS; MAPK13; PRKCD; GSTP1; MAPK9; NOS2A; ABCB1; AHR; PPP2CA; FTL; NFE2L2; PIK3C2A; PPARGC1A; MAPK14; TNF; RAF1; CREBBP; MAP2K2; PIK3R1; PPP2R5C; MAP2K1; KFKB1; KEAP1; PRKCA; EIF2AK3; IL6; CYP1B1; HSP90AA1 |
| SAPK/JNK Signaling | PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRK1A; MAP2K2; PIK3R1; MAP2K1; PAK3; CDC42; JUN; TTK; CSNK1A1; CRKL; BRAF; SGK |
| PPAr/RXR Signaling | PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IRS1; MAPK3; KRAS; RELA; PRKAA1; PPARGC1A; NCOA3; MAPK14; INSR; RAF1; IKBKG; RELB; MAP3K7; CREBBP; MAP2K2; JAK2; CHUK; MAP2K1; NFKB1; TGFBR1; SMAD4; JUN; IL1R1; PRKCA; IL6; HSP9AA1; ADIPOQ |
| NF-KB Signaling | IRAK1; EIF2AK2; EP300; INS; MYD88; PRKCZ; TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4; PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; IL1R1 |
| Neuregulin Signaling | ERBB4; PRKCE; ITGAM; ITGA5; PTEN; PRKCZ; ELK1; MAPK1; PTPN11; AKT2; EGFR; ERBB2; PRKCI; CDKN1B; STAT5B; PRKD1; MAPK3; ITGAl; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HSP90AA1; RP S6KB1 |
| Wnt & Beta catenin Signaling | CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2; ILK; LEF1; SOX9; TP53; MAP3K7; CREBBP; TCF7L2; AKT1; PPP2R5C; WNT5A; LRP5; CTNNB1; TGFBR1; CCND1; GSK3A; DVL1; APC; CDKN2A; MYC; CSNK1A1; GSK3B; AKT3; SOX2 |
| Insulin Receptor Signaling | PTEN; INS; EIF4E; PTPN1; PRKCZ; MAPK1; TSC1; PTPN11; AKT2; CBL; PIK3CA; PRKCI; PIK3CB; PIK3C3; MAPK8; IRS1; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1 |
| IL-6 Signaling | HSPB1; TRAF6; MAPKAPK2; ELK1; MAPK1; PTPN11; IKBKB; FOS; NFKB2; MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; IL1R1; SRF; IL6 |
| Hepatic Cholestasis | PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; IL8; CHUK; NR1H2; TJP2; NFKB1; ESR1; SREBF 1; FGFR4; JUN; IL1R1; PRKCA; IL6 |
| IGF-1 Signaling | IGF1; PRKCZ; ELK1; MAPK1; PTPN11; NEDD4; AKT2; PIK3CA; PRKCI; PTK2; FOS; PIK3CB; PIK3C3; MAPK8; GF1R; IRS1; MAPK3; IGFBP7; KRAS; PIK3C2A; |

TABLE 10-continued

| CELLULAR FUNCTION | GENES |
|---|---|
| | YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1 |
| NRF2-mediated Oxidative Stress Response | PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1; MAP2K1; PPIB; JUN; KEAP1 ; GSK3B; ATF4; PRKCA; EIF2AK3; HSP90AA1 |
| Hepatic Fibrosis/Hepatic Stellate Cell Activation | EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; IL1R1; CCL2; HGF; MMP1; STAT1; IL6; CTGF; MMP9 |
| PPAR Signaling | EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGC1A; PDGFRB; TNF; INSR; RAF1; IKBKG; RELB; MAP3K7; CREBBP; MAP2K2; CHUK; PDGFRA; MAP2K1; NFKB1; JUN; IL1R1; HSP90AA1 |
| Fc Epsilon RI Signaling | PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3 ; VAV3; PRKCA |
| G-Protein Coupled Receptor Signaling | PRKCE; RAP1A; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; STAT3; MAP2K1; NFKB1; BRAF; ATF4; AKT3; PRKCA |
| Inositol Phosphate Metabolism | PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK |
| PDGF Signaling | EIF2AK2; ELK1; ABL2; MAPK1; PIK3CA; FOS; PIK3CB; PIK3C3; MAPK8; CAV1; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 |
| VEGF Signaling | ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIF1A; NOS3; PIK3C2A; PXN; RAF1; MAP2K2; ELAVL1; AKT1; PIK3R1; MAP2K1; SFN; VEGFA; AKT3; FOXO1; PRKCA |
| Natural Killer Cell Signaling | PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA |
| Cell Cycle: G1/S Checkpoint Regulation | HDAC4; SMAD3; SUV39H1; HDAC5; CDKN1B; BTRC; ATR; ABL1; E2F1; HDAC2; HDAC7A; RB1; HDAC11; HDAC9; CDK2; E2F2; HDAC3; TP53; CDKN1A; CCND1; E2F4; ATM; RBL2; SMAD4; CDKN2A; MYC; NRG1; GSK3B; RBL1; HDAC6 |
| T Cell Receptor Signaling | RAC1; ELK1; MAPK1; IKBKB; CBL; PIK3CA; FOS; NFKB2; PIK3CB; PIK3C3; MAPK8; MAPK3; KRAS; RELA; PIK3C2A; BTK; LCK; RAF1; IKBKG; RELB; FYN; MAP2K2; PIK3R1; CHUK; MAP2K1; NFKB1; ITK; BCL10; JUN; VAV3 |
| Death Receptor Signaling | CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB; CASP9; CHUK; APAF1; NFKB1; CASP2; BIRC2; CASP3; BIRC3 |
| FGF Signaling | RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF |
| GM-CSF Signaling | LYN; ELK1; MAPK1; PTPN11; AKT2; PIK3CA; CAMK2A; |
| | STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1 |

TABLE 10-continued

| CELLULAR FUNCTION | GENES |
|---|---|
| Amyotrophic Lateral Sclerosis Signaling | BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 |
| JAK/Stat Signaling | PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1 |
| Nicotinate and Nicotinamide Metabolism | PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRK1A; MAP2K2; MAP2K1; PAK3; NT5E; TTK; CSNK1A1; BRAF; SGK |
| Chemokine Signaling | CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA |
| IL-2 Signaling | ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3 |
| Synaptic Long Term Depression | PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NO53; NOS2A; PPP2CA; YWHAZ; RAF1; MAP2K2; PPP2R5C; MAP2K1; PRKCA |
| Estrogen Receptor Signaling | TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1; ESR2 |
| Protein Ubiquitination Pathway | TRAF6; SMURF1; BIRC4; BRCA1; UCHL1; NEDD4; CBL; UBE2I; BTRC; HSPA5; USP7; USP10; FBXW7; USP9X; STUB1; USP22; B2M; BIRC2; PARK2; USP8; USP1; VHL; HSP90AA1; BIRC3 |
| IL-10 Signaling | TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; IL1R1; IL6 |
| VDR/RXR Activation | PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LRP5; CEBPB; FOXO1; PRKCA |
| TGF-beta Signaling | EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5 |
| Toll-like Receptor Signaling | IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN |
| p38 MAPK Signaling | HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1 |
| Neurotrophin/TRK Signaling | NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4 |
| FXR/RXR Activation | INS; PPARA; FASN; RXRA; AKT2; SDC1; MAPK8; APOB; MAPK10; PPARG; MTTP; MAPK9; PPARGC1A; TNF; CREBBP; AKT1; SREBF1; FGFR4; AKT3; FOXO1 |
| Synaptic Long Term Potentiation | PRKCE; RAP1A; EP300; PRKCZ; MAPK1; CREB1; PRKCI; GNAQ; CAMK2A; PRKD1; MAPK3; KRAS; PRKCD; PPP1CC; RAF1; CREBBP; MAP2K2; MAP2K1; ATF4; PRKCA |
| Calcium Signaling | RAP1A; EP300; HDAC4; MAPK1; HDAC5; CREB1; CAMK2A; MYH9; MAPK3; HDAC2; HDAC7A; HDAC11; HDAC9; HDAC3; CREBBP; CALR; CAMKK2; ATF4; HDAC6 |
| EGF Signaling | ELK1; MAPK1; EGFR; PIK3CA; FOS; PIK3CB; PIK3C3; MAPK8; MAPK3; PIK3C2A; RAF1; JAK1; PIK3R1; STAT3; MAP2K1; JUN; PRKCA; SRF; STAT1 |
| Hypoxia Signaling in the Cardiovascular System | EDN1; PTEN; EP300; NQO1; UBE2I; CREB1; ARNT; HIF1A; SLC2A4; NOS3; TP53; LDHA; AKT1; ATM; VEGFA; JUN; ATF4; VHL; HSP90AA1 |
| LPS/IL-1 Mediated Inhibition of RXR Function | IRAK1; MYD88; TRAF6; PPARA; RXRA; ABCA1; MAPK8; ALDH1A1; GSTP1; MAPK9; ABCB1; TRAF2; TLR4; TNF; MAP3K7; NR1H2; SREBF1; JUN; IL1R1 |

TABLE 10-continued

| CELLULAR FUNCTION | GENES |
|---|---|
| LXR/RXR Activation | FASN; RXRA; NCOR2; ABCA1; NFKB2; IRF3; RELA; NOS2A; TLR4; TNF; RELB; LDLR; NR1H2; NFKB1; SREBF1; IL1R1; CCL2; IL6; MMP9 |
| Amyloid Processing | PRKCE; CSNK1E; MAPK1; CAPNS1; AKT2; CAPN2; CAPN1; MAPK3; MAPK13; MAPT; MAPK14; AKT1; PSEN1; CSNK1A1; GSK3B; AKT3; APP |
| IL-4 Signaling | AKT2; PIK3CA; PIK3CB; PIK3C3; IRS1; KRAS; SOCS1; PTPN6; NR3C1; PIK3C2A; JAK1; AKT1; JAK2; PIK3R1; FRAP1; AKT3; RPS6KB1 |
| Cell Cycle: G2/M DNA Damage Checkpoint Regulation | EP300; PCAF; BRCA1; GADD45A; PLK1; BTRC; CHEK1; ATR; CHEK2; YWHAZ; TP53; CDKN1A; PRKDC; ATM; SFN; CDKN2A |
| Nitric Oxide Signaling in the Cardiovascular System | KDR; FLT1; PGF; AKT2; PIK3CA; PIK3CB; PIK3C3; CAV1; PRKCD; NOS3; PIK3C2A; AKT1; PIK3R1; VEGFA; AKT3; HSP90AA1 |
| Purine Metabolism | NME2; SMARCA4; MYH9; RRM2; ADAR; EIF2AK4; PKM2; ENTPD1; RAD51; RRM2B; TJP2; RAD51C; NT5E; POLD1; NME1 |
| cAMP-mediated Signaling | RAP1A; MAPK1; GNAS; CREB1; CAMK2A; MAPK3; SRC; RAF1; MAP2K2; STAT3; MAP2K1; BRAF; ATF4 |
| Mitochondrial Dysfunction | SOD2; MAPK8; CASP8; MAPK10; MAPK9; CASP9; PARK7; PSEN1; PARK2; APP; CASP3 |
| Notch Signaling | HES1; JAG1; NUMB; NOTCH4; ADAM17; NOTCH2; PSEN1; NOTCH3; NOTCH1; DLL4 |
| Endoplasmic Reticulum Stress Pathway | HSPA5; MAPK8; XBPI; TRAF2; ATF6; CASP9; ATF4; EIF2AK3; CASP3 |
| Pyrimidine Metabolism | NME2; AICDA; RRM2; EIF2AK4; ENTPD1; RRM2B; NT5E; POLD1; NME1 |
| Parkinson's Signaling | UCHL1; MAPK8; MAPK13; MAPK14; CASP9; PARK7; PARK2; CASP3 |
| Cardiac & Beta Adrenergic Signaling | GNAS; GNAQ; PPP2R1A; GNB2L1; PPP2CA; PPP1CC; PPP2R5C |
| Glycolysis/Gluconeogenesis | HK2; GCK; GPI; ALDH1A1; PKM2; LDHA; HK1 |
| Interferon Signaling | IRF1; SOCS1; JAK1; JAK2; IFITM1; STAT1; IFIT3 |
| Sonic Hedgehog Signaling | ARRB2; SMO; GLI2; DYRK1A; GUI; GSK3B; DYRK1B |
| Glycerophospholipid Metabolism | PLD1; GRN; GPAM; YWHAZ; SPHK1; SPHK2 |
| Phospholipid Degradation | PRDX6; PLD1; GRN; YWHAZ; SPHK1; SPHK2 |
| Tryptophan Metabolism | SIAH2; PRMT5; NEDD4; ALDH1A1; CYP1B1; SIAH1 |
| Lysine Degradation | SUV39H1; EHMT2; NSD1; SETD7; PPP2R5C |
| Nucleotide Excision Repair Pathway | ERCC5; ERCC4; XPA; XPC; ERCC1 |
| Starch and Sucrose Metabolism | UCHL1; HK2; GCK; GPI; HK1 |
| Amnosugars Metabolism | NQO1; HK2; GCK; HK1 |
| Arachidonic Acid Metabolism | PRDX6; GRN; YWHAZ; CYP1B1 |
| Circadian Rhythm Signaling | CSNK1E; CREB1; ATF4; NR1D1 |
| Coagulation System | BDKRB1; F2R; SERPINE1; F3 |
| Dopamine Receptor Signaling | PPP2R1A; PPP2CA; PPP1CC; PPP2R5C |
| Glutathione Metabolism | IDH2; GSTP1; ANPEP; IDH1 |
| Glycerolipid Metabolism | ALDH1A1; GPAM; SPHK1; SPHK2 |
| L noleic Acid Metabolism | PRDX6; GRN; YWHAZ; CYP1B1 |
| Methionine Metabolism | DNMT1; DNMT3B; AHCY; DNMT3A |
| Pyruvate Metabolism | GLO1; ALDH1A1; PKM2; LDHA |
| Arginine and Proline Metabolism | ALDH1A1; NOS3; NOS2A |
| Eicosanoid Signaling | PRDX6; GRN; YWHAZ |
| Fructose and Mannose Metabolism | HK2; GCK; HK1 |
| Galactose Metabolism | HK2; GCK; HK1 |
| Stilbene, Coumarine and Lignin Biosynthesis | PRDX6; PRDX1; TYR |
| Antigen Presentation Pathway | CALR; B2M |
| Biosynthesis of Steroids | NQO1; DHCR7 |
| Butanoate Metabolism | ALDH1A1; NLGN1 |
| Citrate Cycle | IDH2; IDH1 |
| Fatty Acid Metabolism | ALDH1A1; CYP1B1 |
| Glycerophospholipid Metabolism | PRDX6; CHKA |
| Histidine Metabolism | PRMT5; ALDH1A1 |
| Inositol Metabolism | ERO1L; APEX1 |
| Metabolism of Xenobiotics by Cytochrome p450 | GSTP1; CYP1B1 |
| Methane Metabolism | PRDX6; PRDX1 |
| Phenylalanine Metabolism | PRDX6; PRDX1 |

TABLE 10-continued

| CELLULAR FUNCTION | GENES |
|---|---|
| Propanoate Metabolism | ALDH1A1; LDHA |
| Selenoam no Acid Metabolism | PRMT5; AHCY |
| Sphingolipid Metabolism | SPHK1; SPHK2 |
| Amnophosphonate Metabolism | PRMT5 |
| Androgen and Estrogen Metabolism | PRMT5 |
| Ascorbate and Aldarate Metabolism | ALDH1A1 |
| Bile Acid Biosynthesis | ALDH1A1 |
| Cysteine Metabolism | LDHA |
| Fatty Acid Biosynthesis | FASN |
| Glutamate Receptor Signaling | GNB2L1 |
| NRF2-mediated Oxidative Stress Response | PRDX1 |
| Pentose Phosphate Pathway | GPI |
| Pentose and Glucuronate Interconversions | UCHL1 |
| Retinol Metabolism | ALDH1A1 |
| Riboflavin Metabolism | TYR |
| Tyrosine Metabolism | PRMT5, TYR |
| Ubiquinone Biosynthesis | PRMT5 |
| Valine, Leucine and Isoleucine Degradation | ALDH1A1 |
| Glycine, Serine and Threonine Metabolism | CHKA |
| Lysine Degradation | ALDH1A1 |
| Pain/Taste | TRPM5; TRPA1 |
| Pain | TRPM7; TRPC5; TRPC6; TRPC1; Cnr1; cnr2; Grk2; Trpa1; Pomc; Cgrp; Crf; Pka; Era; Nr2b; TRPM5; Prkaca; Prkacb; Prkar1a; Prkar2a |
| Mitochondrial Function | AIF; CytC; SMAC (Diablo); Aifm-1; Aifm-2 |
| Developmental Neurology | BMP-4; Chordin (Chrd); Noggin (Nog); WNT (Wnt2; Wnt2b; Wnt3a; Wnt4; Wnt5a; Wnt6; Wnt7b; Wnt8b; Wnt9a; Wnt9b; Wnt10a; Wnt10b; Wnt16); beta-catenin; Dkk-1; Frizzled related proteins; Otx-2; Gbx2; FGF-8; Reelin; Dab1; unc-86 (Pou4f1 or Brn3a); Numb; Reln |

Embodiments of the invention also relate to methods and compositions related to knocking out genes, amplifying genes and repairing particular mutations associated with DNA repeat instability and neurological disorders (Robert D. Wells, Tetsuo Ashizawa, Genetic Instabilities and Neurological Diseases, Second Edition, Academic Press, Oct. 13, 2011-Medical). Specific aspects of tandem repeat sequences have been found to be responsible for more than twenty human diseases (New insights into repeat instability: role of RNA-DNA hybrids. McIvor E I, Polak U, Napierala M. RNA Biol. 2010 September-October; 7(5):551-8). The present effector protein systems may be harnessed to correct these defects of genomic instability.

Several further aspects of the invention relate to correcting defects associated with a wide range of genetic diseases which are further described on the website of the National Institutes of Health under the topic subsection Genetic Disorders (website at health.nih.gov/topic/GeneticDisorders). The genetic brain diseases may include but are not limited to Adrenoleukodystrophy, Agenesis of the Corpus Callosum, Aicardi Syndrome, Alpers' Disease, Alzheimer's Disease, Barth Syndrome, Batten Disease, CADASIL, Cerebellar Degeneration, Fabry's Disease, Gerstmann-Straussler-Scheinker Disease, Huntington's Disease and other Triplet Repeat Disorders, Leigh's Disease, Lesch-Nyhan Syndrome, Menkes Disease, Mitochondrial Myopathies and NINDS Colpocephaly. These diseases are further described on the website of the National Institutes of Health under the subsection Genetic Brain Disorders.

Additional Embodiments of Applications

In particular embodiments, the methods described herein may involve targeting one or more polynucleotide targets of interest. The polynucleotide targets of interest may be targets which are relevant to a specific disease or the treatment thereof, relevant for the generation of a given trait of interest or relevant for the production of a molecule of interest. When referring to the targeting of a "polynucleotide target" this may include targeting one or more of a coding regions, an intron, a promoter and any other 5' or 3' regulatory regions such as termination regions, ribosome binding sites, enhancers, silencers etc. The gene may encode any protein or RNA of interest. Accordingly, the target may be a coding region which can be transcribed into mRNA, tRNA or rRNA, but also recognition sites for proteins involved in replication, transcription and regulation thereof.

In particular embodiments, the methods described herein may involve targeting one or more genes of interest, wherein at least one gene of interest encodes a long noncoding RNA (lncRNA). While lncRNAs have been found to be critical for cellular functioning. As the lncRNAs that are essential have been found to differ for each cell type (C. P. Fulco et al., 2016, Science, doi:10.1126/science.aag2445; N. E. Sanjana et al., 2016, Science, doi:10.1126/science.aaf8325), the methods provided herein may involve the step of determining the lncRNA that is relevant for cellular function for the cell of interest.

In an exemplary method for modifying a target polynucleotide by integrating an exogenous polynucleotide template, a double stranded break is introduced into the genome sequence by the CRISPR complex, the break is repaired via homologous recombination an exogenous polynucleotide template such that the template is integrated into the genome. The presence of a double-stranded break facilitates integration of the template.

In other embodiments, this invention provides a method of modifying expression of a polynucleotide in a eukaryotic cell. The method comprises increasing or decreasing expression of a target polynucleotide by using a CRISPR complex that binds to the polynucleotide.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

In some methods, a control sequence can be inactivated such that it no longer functions as a control sequence. As used herein, "control sequence" refers to any nucleic acid sequence that effects the transcription, translation, or accessibility of a nucleic acid sequence. Examples of a control sequence include, a promoter, a transcription terminator, and an enhancer are control sequences. The inactivated target sequence may include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). In some methods, the inactivation of a target sequence results in "knockout" of the target sequence.

Also provided herein are methods of functional genomics which involve identifying cellular interactions by introducing multiple combinatorial perturbations and correlating observed genomic, genetic, proteomic, epigenetic and/or phenotypic effects with the perturbation detected in single cells, also referred to as "perturb-seq". In one embodiment, these methods combine single-cell RNA sequencing (RNA-seq) and clustered regularly interspaced short palindromic repeats (CRISPR)-based perturbations (Dixit et al. 2016, Cell 167, 1853-1866; Adamson et al. 2016, Cell 167, 1867-1882). Generally, these methods involve introducing a number of combinatorial perturbations to a plurality of cells in a population of cells, wherein each cell in the plurality of the cells receives at least 1 perturbation, detecting genomic, genetic, proteomic, epigenetic and/or phenotypic differences in single cells compared to one or more cells that did not receive any perturbation, and detecting the perturbation(s) in single cells; and determining measured differences relevant to the perturbations by applying a model accounting for co-variates to the measured differences, whereby intercellular and/or intracellular networks or circuits are inferred. More particularly, the single cell sequencing comprises cell barcodes, whereby the cell-of-origin of each RNA is recorded. More particularly, the single cell sequencing comprises unique molecular identifiers (UMI), whereby the capture rate of the measured signals, such as transcript copy number or probe binding events, in a single cell is determined.

These methods can be used for combinatorial probing of cellular circuits, for dissecting cellular circuitry, for delineating molecular pathways, and/or for identifying relevant targets for therapeutics development. More particularly, these methods may be used to identify groups of cells based on their molecular profiling. Similarities in gene-expression profiles between organic (e.g. disease) and induced (e.g. by small molecule) states may identify clinically-effective therapies.

Accordingly, in particular embodiments, therapeutic methods provided herein comprise, determining, for a population of cells isolated from a subject, optimal therapeutic target and/or therapeutic, using perturb-seq as described above.

In particular embodiments, pertub-seq methods as referred to herein elsewhere are used to determine, in an isolated cell or cell line, cellular circuits which may affect production of a molecule of interest.

The subject invention may be used as part of a research program wherein there is transmission of results or data. A computer system (or digital device) may be used to receive, transmit, display and/or store results, analyze the data and/or results, and/or produce a report of the results and/or data and/or analysis. A computer system may be understood as a logical apparatus that can read instructions from media (e.g. software) and/or network port (e.g. from the internet), which can optionally be connected to a server having fixed media. A computer system may comprise one or more of a CPU, disk drives, input devices such as keyboard and/or mouse, and a display (e.g. a monitor). Data communication, such as transmission of instructions or reports, can be achieved through a communication medium to a server at a local or a remote location. The communication medium can include any means of transmitting and/or receiving data. For example, the communication medium can be a network connection, a wireless connection, or an internet connection. Such a connection can provide for communication over the World Wide Web. It is envisioned that data relating to the present invention can be transmitted over such networks or connections (or any other suitable means for transmitting information, including but not limited to mailing a physical report, such as a print-out) for reception and/or for review by a receiver. The receiver can be but is not limited to an individual, or electronic system (e.g. one or more computers, and/or one or more servers). In some embodiments, the computer system comprises one or more processors. Processors may be associated with one or more controllers, calculation units, and/or other units of a computer system, or implanted in firmware as desired. If implemented in software, the routines may be stored in any computer readable memory such as in RAM, ROM, flash memory, a magnetic disk, a laser disk, or other suitable storage medium. Likewise, this software may be delivered to a computing device via any known delivery method including, for example, over a communication channel such as a telephone line, the internet, a wireless connection, etc., or via a transportable medium, such as a computer readable disk, flash drive, etc. The various steps may be implemented as various blocks, operations, tools, modules and techniques which, in turn, may be implemented in hardware, firmware, software, or any combination of hardware, firmware, and/or software. When implemented in hardware, some or all of the blocks, operations, techniques, etc. may be implemented in, for example, a custom integrated circuit (IC), an application specific integrated circuit (ASIC), a field programmable logic array (FPGA), a programmable logic array (PLA), etc. A client-server, relational database architecture can be used in embodiments of the invention. A client-server architecture is a network architecture in which each computer or process on the network is either a client or a server. Server computers are typically powerful computers dedicated to managing disk drives (file servers), printers (print servers), or network traffic (network servers). Client computers include PCs (personal computers) or workstations on which users run applications, as well as example output devices as disclosed herein. Client computers rely on server computers for resources, such as files, devices, and even processing power. In some embodiments of the invention, the server computer handles all of the database functionality. The client computer can have software that handles all the front-end data management and can also receive data input from users. A machine readable medium comprising computer-executable code may take many forms, including but not limited to, a In some embodiments, the systems or complexes can target nucleic acid molecules, e.g., CRISPR-Type V effector complexes can target and cleave or nick or simply sit upon a target DNA molecule (depending if the Type V effector has mutations that render it a nickase or "dead"). Such systems or complexes are amenable for achieving tissue-specific and temporally controlled targeted deletion of candidate disease genes. Examples include but are not limited to genes involved in cholesterol and fatty acid metabolism, amyloid diseases, dominant negative diseases, latent viral infections, among other disorders. Accordingly, target sequences for such systems or complexes can be in candidate disease genes, e.g.:

TABLE 11

Table 10 - Diseases and Targets

| Disease | GENE | SPACER | PAM | Mechanism | References |
|---|---|---|---|---|---|
| Hypercholes-terolemia | HMG-CR | GCCAAATTGGAC GACCCTCG (SEQ ID NO: 434) | CGG | Knockout | Fluvastatin: a review of its pharmacology and use in the management of hypercholesterolaemia. (Plosker GL et al. Drugs 1996, 51(3):433-459) |
| Hypercholes-terolemia | SQLE | CGAGGAGACCCC CGTTTCGG (SEQ ID NO:435) | TGG | Knockout | Potential role of nonstatin cholesterol lowering agents (Trapani et al. IUBMB Life, Volume 63, Issue 11, pages 964-971, November 2011) |
| Hyper-lipidema | DGAT1 | CCCGCCGCCGCC GTGGCTCG (SEQ ID NO: 436) | AGG | Knockout | DGAT1 inhibitors as anti-obesity and anti-diabetic agents. (Birch AM et al. Current Opinion in Drug Discovery & Development [2010, 13(4):489-496) |
| Leukemia | BCR-ABL | TGAGCTCTACGA GATCCACA (SEQ ID NO: 437) | AGG | Knockout | Killing of leukemic cells with a BCR/ABL fusion gene by RNA interference (RNAi). (Fuchs et al. Oncogene 2002, 21(37):5716-5724) | tangible storage medium, a carrier wave medium or physical transmission medium. Non-volatile storage media include, for example, optical or magnetic disks, such as any of the storage devices in any computer(s) or the like, such as may be used to implement the databases, etc. shown in the drawings. Volatile storage media include dynamic memory, such as main memory of such a computer platform. Tangible transmission media include coaxial cables; copper wire and fiber optics, including the wires that comprise a bus within a computer system. Carrier-wave transmission media may take the form of electric or electromagnetic signals, or acoustic or light waves such as those generated during radio frequency (RF) and infrared (IR) data communications. Common forms of computer-readable media therefore include for example: a floppy disk, a flexible disk, hard disk, magnetic tape, any other magnetic medium, a CD-ROM, DVD or DVD-ROM, any other optical medium, punch cards paper tape, any other physical storage medium with patterns of holes, a RAM, a ROM, a PROM and EPROM, a FLASH-EPROM, any other memory chip or cartridge, a carrier wave transporting data or instructions, cables or links transporting such a carrier wave, or any other medium from which a computer may read programming code and/or data. Many of these forms of computer readable media may be involved in carrying one or more sequences of one or more instructions to a processor for execution. Accordingly, the invention comprehends performing any method herein-discussed and storing and/or transmitting data and/or results therefrom and/or analysis thereof, as well as products from performing any method herein-discussed, including intermediates.

Kits

In another aspect, the disclosure includes kits and kits of parts. The terms "kit of parts" and "kit" as used throughout this specification refer to a product containing components necessary for carrying out the specified methods (e.g., methods for detecting, quantifying or isolating immune cells as taught herein), packed so as to allow their transport and storage. Materials suitable for packing the components comprised in a kit include crystal, plastic (e.g., polyethylene, polypropylene, polycarbonate), bottles, flasks, vials, ampules, paper, envelopes, or other types of containers, carriers or supports. Where a kit comprises a plurality of components, at least a subset of the components (e.g., two or more of the plurality of components) or all of the components may be physically separated, e.g., comprised in or on separate containers, carriers or supports. The components comprised in a kit may be sufficient or may not be sufficient for carrying out the specified methods, such that external reagents or substances may not be necessary or may be necessary for performing the methods, respectively. Typically, kits are employed in conjunction with standard laboratory equipment, such as liquid handling equipment, environment (e.g., temperature) controlling equipment, analytical instruments, etc. In addition to the recited binding agents(s) as taught herein, such as for example, antibodies, hybridization probes, amplification and/or sequencing primers, optionally provided on arrays or microarrays, the present kits may also include some or all of solvents, buffers (such as for example but without limitation histidine-buffers, citrate-buffers, succinate-buffers, acetate-buffers, phosphate-buffers, formate buffers, benzoate buffers, TRIS (Tris (hydroxymethyl)-aminomethan) buffers or maleate buffers, or mixtures thereof), enzymes (such as for example but without limitation thermostable DNA polymerase), detectable labels, detection reagents, and control formulations (positive and/or negative), useful in the specified methods. Typically, the kits may also include instructions for use thereof, such as on a printed insert or on a computer readable medium. The terms may be used interchangeably with the term "article of manufacture", which broadly encompasses any man-made tangible structural product, when used in the present context.

OTHER EMBODIMENTS

The present application also provides aspects and embodiments as set forth in the following numbered Statements:

Statement 1. An engineered nucleic acid targeting system for insertion of donor polynucleotides, the system comprising: one or more CRISPR-associated transposase proteins or functional fragments thereof; a Cas protein; and a guide molecule capable of complexing with the Cas protein and directing sequence specific binding of the guide-Cas protein complex to a target sequence of a target polynucleotide.

Statement 2. The system of Statement 1, wherein the one or more CRISPR-associated transposase proteins comprises TnsB and TnsC.

Statement 3. The system of any one of Statemetns 1-2, wherein the one or more CRISPR-associated transposase proteins comprise: a) TnsA, TnsB, TnsC, and TniQ, b) TnsA, TnsB, and TnsC, c) TnsB, TnsC, and TniQ, d) TnsA, TnsB, and TniQ, e) TnsE, TniA, TniB, and TniQ, g) TnsB, TnsC, and TnsD, or h) any combination thereof.

Statement 4. The system of any one of Statemetns 1-3, wherein the one or more CRISPR-associated transposase proteins comprise TnsB, TnsC, and TniQ.

Statement 5. The system of any one of Statemetns 1-4, wherein the TnsB, TnsC, and TniQ are encoded by polynucleotides in Table 26 or Table 27, or are proteins in Table 28 or Table 29.

Statement 6. The system of any one of Statemetns 1-5, wherein the TnsE does not bind to DNA.

Statement 7. The system of any one of Statemetns 1-6, wherein the one or more CRISPR-associated transposase proteins are one or more Tn5 transposases.

Statement 8. The system of any one of Statemetns 1-7, wherein the one or more CRISPR-associated transposase proteins are one or more Tn7 transposases.

Statement 9. The system of any one of Statemetns 1-8, wherein the one or more CRISPR-associated transposase proteins comprises TnpA.

Statement 10. The system of any one of Statemetns 1-9, wherein the one or more CRISPR-associated transposase proteins comprises TnpAIS608.

Statement 11. The system of any one of Statemetns 1-10, further comprising a donor polynucleotide for insertion into the target polynucleotide.

Statement 12. The system of Statement 11, wherein the donor polynucleotide is to be inserted at a position between 40 and 100 bases downstream a PAM sequence in the target polynucleotide.

Statement 13. The system of Statement 11 or 12, wherein the donor polynucleotide is flanked by a right end sequence element and a left end sequence element.

Statement 14. The system of Statement 11, 12, or 13, wherein the donor polynucleotide: a) introduces one or more mutations to the target polynucleotide, b) introduces or corrects a premature stop codon in the target polynucleotide, c) disrupts a splicing site, d) restores or introduces a splice cite, e) inserts a gene or gene fragment at one or both alleles of a target polynucleotide, or f) a combination thereof.

Statement 15. The system of Statement 14, wherein the one or more mutations introduced by the donor polynucleotide comprises substitutions, deletions, insertions, or a combination thereof.

Statement 16. The system of Statement 15, wherein the one or more mutations causes a shift in an open reading frame on the target polynucleotide.

Statement 17. The system of Statement 15 or 16, wherein the donor polynucleotide is between 100 bases and 30 kb in length.

Statement 18. The system of any one of Statement 1-17, wherein the Cas protein is a Type V Cas protein.

Statement 19. The system of any one of Statement 1-18, wherein the Type V Cas protein is a Type V-J Cas protein.

Statement 20. The system of any one of Statement 1-19, wherein the Cas protein is Cas12.

Statement 21. The system of Statement 20, wherein the Cas12 is Cas12a or Cas12b.

Statement 22. The system of Statement 20 or 21, wherein the Cas 12 is Cas12k.

Statement 23. The system of Statement 22, wherein the Cas12k is encoded by a polynucleotide in Table 26 or Table 27, or is a protein in Table 28 or Table 29.

Statement 24. The system of Statement 22 or 23, wherein the Cas12k is of an organism of FIGS. 2A and 2B, or Table 26.

Statement 25. The system of any one of Statement 1-24, wherein the Cas protein comprises an activation mutation.

Statement 26. The system of any one of Statement 1-25, wherein the Cas protein is a Type I Cas protein.

Statement 27. The system of any one of Statement 1-26, wherein the Type I Cas protein comprises Cas5f, Cas6f, Cas7f, and Cas8f.

Statement 28. The system of any one of Statement 1-27, wherein the Type I Cas protein comprises Cas8f-Cas5f, Cas6f and Cas7f.

Statement 29. The system of any one of Statement 1-28, wherein the Type I Cas protein is a Type I-F Cas protein.

Statement 30. The system of any one of Statement 1-29, wherein the Cas protein is a Type II Cas protein.

Statement 31. The system of Statement 30, wherein the Type II Cas protein is a mutated Cas protein compared to a wildtype counterpart.

Statement 32. The system of Statement 31, wherein the mutated Cas protein is a mutated Cas9.

Statement 33. The system of Statement 32, wherein the mutated Cas9 is Cas9D10A.

Statement 34. The system of any one of Statements 1-33, wherein the Cas protein lacks nuclease activity.

Statement 35. The system of any one of Statements 1-34, further comprising a donor polynucleotide.

Statement 36. The system of any one of Statements 1-35, wherein the CRISPR-Cas system comprises a DNA binding domain.

Statement 37. The system of any one of Statements 1-36, wherein the DNA binding domain is a dead Cas protein.

Statement 38. The system of Statement 37, wherein the dead Cas protein is dCas9, dCas12a, or dCas12b.

Statement 39. The system of any one of Statements 1-38, wherein the DNA binding domain is an RNA-guided DNA binding domain.

Statement 40. The system of any one of Statements 1-39, wherein the target nucleic acid has a PAM.

Statement 41. The system of Statement 40, wherein the PAM is on the 5' side of the target and comprises TTTN or ATTN.

Statement 42. The system of Statement 40 or 41, wherein the PAM comprises NGTN, RGTR, VGTD, or VGTR.

Statement 43. The system of Statement 42, wherein the guide molecule is an RNA molecule encoded by a polynucleotide in Table 26.

Statement 44. An engineered system comprising one or more polynucleotides encoding components (a), (b) and/or (c) of any one of Statements 1-43.

Statement 45. The system of Statement 44, wherein one or more polynucleotides are operably linked to one or more regulatory sequence.

Statement 46. The system of any one of Statements 44-45, which comprises one or more components of a transposon.

Statement 47. The system of any one of Statements 44-46, wherein the one or more of the protein and nucleic acid components are comprised by a vector.

Statement 48. The system of any one of Statements 44-47, wherein the one or more transposases comprises TnsB, TnsC, and TniQ, and the Cas protein is Cas12k.

Statement 49. The system of any one of Statements 44-48, wherein the one or more polynucleotides are selected from polynucleotides in Table 26.

Statement 50. A vector comprising one or more polynucleotides encoding components (a), (b) and/or (c) of any one of Statements 1-49.

Statement 51. A cell or progeny thereof comprising the vector of Statement 50.

Statement 52. A cell comprising the system of any one of Statements 1 to 50, or a progeny thereof comprising one or more insertions made by the system.

Statement 53. The cell of Statement 51 or 52, wherein the cell is a prokaryotic cell.

Statement 54. The cell of any one of Statements 51-53, wherein the cell is a eukaryotic cell.

Statement 55. The cell of any one of Statements 51-54, wherein the cell is a mammalian cell, a cell of a non-human primate, or a human cell.

Statement 56. The cell of any one of Statements 51-55, wherein the cell is a plant cell.

Statement 57. An organism or a population thereof comprising the cell of any one of Statements 51-56.

Statement 58. A method of inserting a donor polynucleotide into a target polynucleotide in a cell, which comprises introducing into the cell: a) one or more CRISPR-associated transposases or functional fragments thereof, b) a Cas protein, c) a guide molecule capable of binding to a target sequence on a target polynucleotide, and designed to form a CRISPR-Cas complex with the Cas protein, and d) a donor polynucleotide, wherein the CRISPR-Cas complex directs the CRISPR-associated transposase to the target sequence and the CRISPR-associated transposase inserts the donor polynucleotide into the target polynucleotide at or near the target sequence.

Statement 59. The method of Statement 58, wherein the donor polynucleotide is to be inserted at a position between 40 and 100 bases downstream a PAM sequence in the target polynucleotide.

Statement 60. The method of Statement 59, wherein the donor polynucleotide: a) introduces one or more mutations to the target polynucleotide, b) corrects or introduces a premature stop codon in the target polynucleotide, c) disrupts a splicing site, d) restores or introduces a splice site, e) inserts a gene or gene fragment at one or both alleles of a target polynucleotide or f) a combination thereof.

Statement 61. The method of Statement 59 or 60, wherein the one or more mutations introduced by the donor polynucleotide comprises substitutions, deletions, insertions, or a combination thereof.

Statement 62. The method of any one of Statements 59-61, wherein the one or more mutations causes a shift in an open reading frame on the target polynucleotide.

Statement 63. The method of any one of Statements 59-62, wherein the donor polynucleotide is between 100 bases and 30 kb in length.

Statement 64. The method of any one of Statements 59-63, wherein one or more of components (a), (b), and (c) is expressed from a nucleic acid operably linked to a regulatory sequence that is expressed in the cell.

Statement 65. The method of any one of Statements 59-64, wherein one or more of components (a), (b), and (c) is introduced in a particle.

Statement 66. The method of any one of Statements 59-65, wherein the particle comprises a ribonucleoprotein (RNP).

Statement 67. The method of any one of Statements 59-66, wherein the cell is a prokaryotic cell.

Statement 68. The method of any one of Statements 59-67, wherein the cell is a eukaryotic cell.

Statement 69. The method of any one of Statements 59-68, wherein the cell is a mammalian cell, a cell of a non-human primate, or a human cell.

Statement 70. The method of any one of Statements 59-69, wherein the cell is a plant cell.

Statement 71. An engineered nucleic acid targeting system for inserting a polynucleotide into a target nucleic acid, which comprises: a) an engineered c2c5 protein or fragment thereof designed to form a complex with TnsBC and linked to a programmable DNA binding domain, b) a guide designed to form a complex with the programmable DNA binding domain and target the complex to the target nucleic acid, c) i) TnsA, TnsB, and TniQ, or ii) TnsB and TnsC, and d) a polynucleotide comprising a nucleic acid to be inserted flanked by right end and left end sequence elements.

Statement 72. An engineered nucleic acid targeting system for inserting a polynucleotide into a target nucleic acid, which comprises: a) a component of a Cas5678f complex designed to bind to TnsABC-TniQ or to TnsABC linked to a programmable DNA binding domain, b) a guide designed to form a complex with the programmable DNA binding domain and target the complex to the target nucleic acid, c) i) TnsA, TnsB, TnsC, and TniQ, or ii) TnsA, TnsB and TnsC, and d) a polynucleotide comprising a nucleic acid to be inserted flanked by right end and left end sequence elements.

Statement 73. A method of inserting a polynucleotide into a target nucleic acid in a cell, which comprises introducing into the cell: a) an engineered TnsE protein or fragment thereof designed to form a complex with TnsABC or TnsBC and linked to a programmable DNA binding domain, b) a guide designed to form a complex with the programmable DNA binding domain and target the complex to the target nucleic acid, c) i) TnsA, TnsB, and TnsC, or ii) TnsB and TnsC, and d) a polynucleotide comprising a nucleic acid to be inserted flanked by right end and left end sequence elements, wherein the guide directs cleavage of the target nucleic acid, whereby the polynucleotide is inserted.

Statement 74. A method of inserting a polynucleotide into a target nucleic acid in a cell, which comprises introducing into the cell: a) an engineered c2c5 protein or fragment thereof designed to form a complex with TnsBC and linked to a programmable DNA binding domain, b) a guide designed to form a complex with the programmable DNA binding domain and target the complex to the target nucleic acid, c) i) TnsA, TnsB, and TniQ, or ii) TnsB and TnsC, and, d) a polynucleotide comprising a nucleic acid to be inserted flanked by right end and left end sequence elements, wherein the guide directs cleavage of the target nucleic acid, whereby the polynucleotide is inserted.

Statement 75. A method of inserting a polynucleotide into a target nucleic acid in a cell, which comprises introducing into the cell: a) a component of a Cas5678f complex designed to bind to TnsABC-TniQ or to TnsABC linked to a programmable DNA binding domain, b) a guide designed to form a complex with the programmable DNA binding domain and target the complex to the target nucleic acid, c) i) TnsA, TnsB, TnsC, and TniQ, or ii) TnsA, TnsB and TnsC, and, d) a polynucleotide comprising a nucleic acid to be inserted flanked by right end and left end sequence elements.

Statement 76. An engineered nucleic acid targeting system for inserting a polynucleotide into a target nucleic acid, which comprises: a) an engineered c2c5 protein or fragment thereof designed to form a complex with TnsBC and linked to a programmable DNA binding domain, b) a guide designed to form a complex with the programmable DNA binding domain and target the complex to the target nucleic acid, c) i) TniA, TniB, and TniQ, or ii) TnsB and TnsC, and TnsD, and d) a polynucleotide comprising a nucleic acid to be inserted flanked by right end and left end sequence elements.

Statement 77. A method of inserting a polynucleotide into a target nucleic acid in a cell, which comprises introducing into the cell: a) a component of a Cas5678f complex designed to bind to TnsABC-TniQ or to TnsABC linked to a programmable DNA binding domain, b) a guide designed to form a complex with the programmable DNA binding domain and target the complex to the target nucleic acid, c) i) TniA, TniB, and TniQ, or ii) TnsB and TnsC, and TnsD, and d) a polynucleotide comprising a nucleic acid to be inserted flanked by right end and left end sequence elements.

Statement 78. The system or composition in any one of Statements 1-77 for use as a medicament for treating a disease.

Statement 79. The system or composition in any one of Statements 1-77 for use in the treatment of a disease.

EXAMPLES

Example 1—Example CAST System

Figure 3:
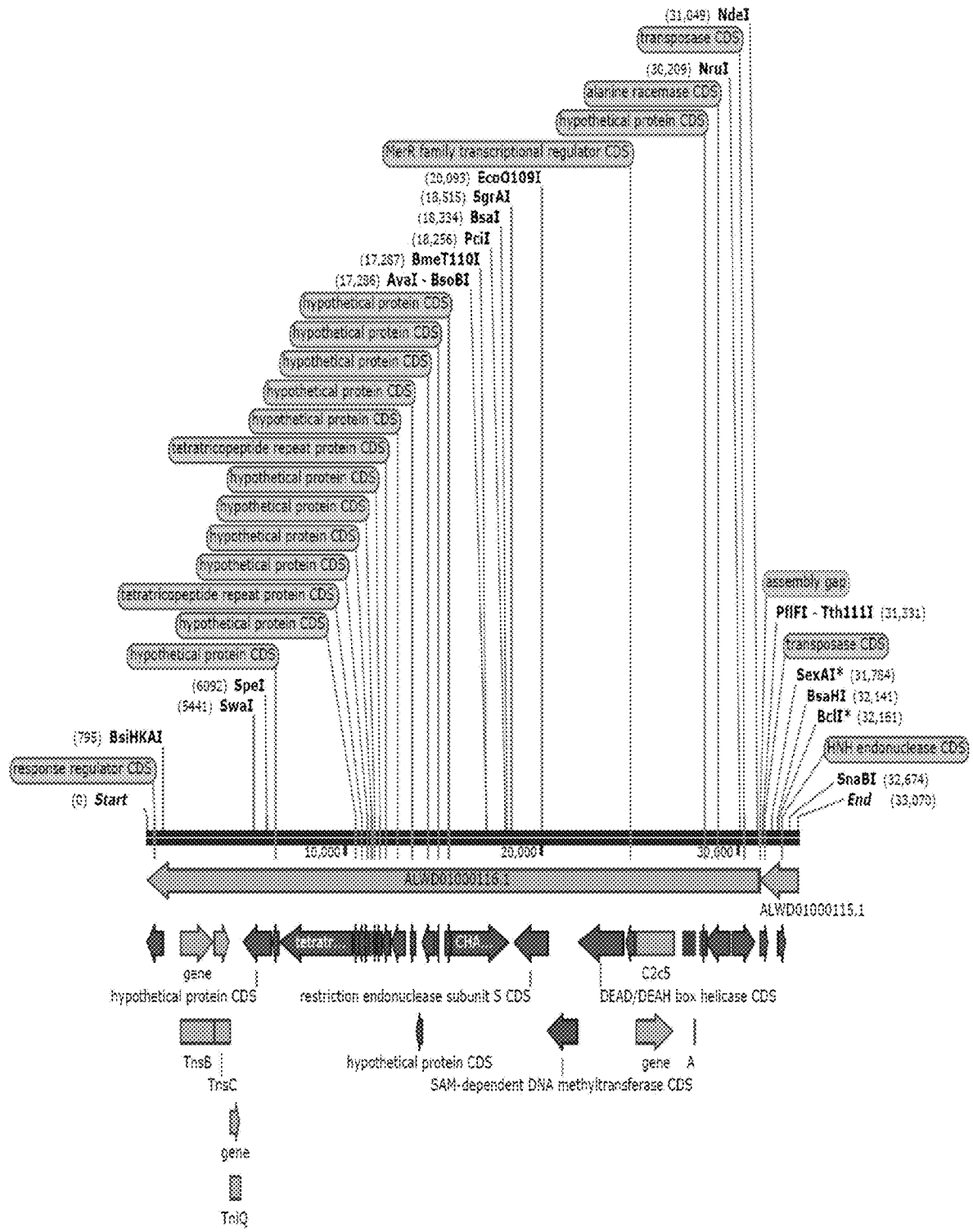
FIG. 3. Map of *Scytonema hoffmanni* UTEX 2349

As shown in FIG. 3 and the table below, the cyanobacteria *Scytonema hofmanni* UTEX 2349 genome encodes transposon- and CRISPR-related gene products:

TABLE 12

| | |
|---|---|
| Response regulator (SEQ ID NO: 438) | MSTIPIGSYKFSQKLHPLSLLAQLTSRRATGCLRIFTGTV SWSIYLEDGKLTYASYSEKLFDRLDNHLQQLSQQIPALNS ATAMQMRLMFEPKGENQPISDADYQAICWLANQAHITSSQ AGMLIENLAKEVLELFLFLKEGSYEFSAENSLNQLPKFCS LDLRLLVEHCQKQLRSQQNSQLPLPAPGKTQVEKATRLPQ SQMQLGQPLPHQSNFDSQDTNNNKMQGQTASKQLYRVACI DDSQTVLNSIKNFLDENTFSVVLINDPVKALMQILRSKPD LILLDVEMPNLDGYELCSLLRRHSAFKNTPIIMVTGRTGF IDRAKAKMVRASGYLTKPFTQPELLKMVFKHIS |
| Transposase (TnsB) WP_084763316.1 (SEQ ID NO: 944) | MNSQQNPDLAVHPLAIPMEGLLGESATTLEKNVIATQLSE EAQVKLEVIQSLLEPCDRTTYGQKLREAAEKLNVSLRTVQ RLVKNWEQDGLVGLTQTSRADKGKHRIGEFWENFITKTYK EGNKGSKRMTPKQVALRVEAKARELKDSKPPNYKTVLRVL APILEKQQKAKSIRSPGWRGTTLSVKTREGKDLSVDYSNH VWQCDHTRVDVLLVDQHGEILSRPWLTTVIDTYSRCIMGI NLGFDAPSSGVVALALRHAILPKRYGSEYKLHCEWGTYGK PEHEYTDGGKDFRSNHLSQIGAQLGFVCHLRDRPSEGGVV ERPFKTLNDQLFSTLPGYTGSNVQERPEDAEKDARLTLRE LEQLLVRYIVDRYNQSIDARMGDQTRFERWEAGLPTVPVP IPERDLDICLMKQSRRTVQRGGCLQFQNLMYRGEYLAGYA GETVNLRFDPRDITTILVYRQENNQEVFLTRAHAQGLETE QLALDEAEAASRRLRTAGKTISNQSLLQEVVDRDALVATK KSRKERQKLEQTVLRSAAVDESNRESLPSQIVEPDEVEST ETVHSQYEDIEVWDYEQLREEYGF |
| Transposase (TnsC) WP_029636336.1 (SEQ ID NO: 945) | MTEAQAIAKQLGGVKPDDEWLQAEIARLKGKSIVPLQQVK TLHDWLDGKRKARKSCRVVGESRTGKTVACDAYRYRHKPQ QEAGRPPTVPVVYIRPHQKCGPKDLEKKITEYLKYRVTKG TVSDERDRTIEVLKGCGVEMLIIDEADRLKPEFFADVRDI AEDLGIAVVLVGTDRLDAVIKRDEQVLERFRABLREGKLS GEDFKNTVEMWEQMVLKLPVSSNLKSKEMLRILTSATEGY IGRLDEILREAAIRSLSRGLKKIDKAVLQEVAKEYK |
| Transposase (TniQ) WP_029636334.1 (SEQ ID NO: 946) | MIEAPDVKPWLFLIKPYEGESLSHFLGRFRRANHLSASGL GTLAGIGAIVARWERFHFNPRPSQQELEAIASVVEVDAQR LAQMLPPAGVGMQHEPIRLCGACYAESPCHRIEWQYKSVW KCDRHQLKILAKCPNCQAPFKMPALWEDGCCHRCRMPFAE MAKLQKV |
| Hypothetical protein (SEQ ID NO: 439) | MDYFSTGKIAYPKLTLYAFHLKHSLSQKPKIPVKNANDLW LKCQQLGKQLGIPKLETLPELIEKANNKKTSITGEILPER FLKFTAIQHQPNLHLSGEANPLEIHDTYALDLTLRYPYSE VKLADLRGLNLDDCLLSKNIKASLGQTLVFFAQPVGKIHD EQAFADACVKALLSEEISQKLNIYCQHQGQLLGSPIFEYN NDADFPEKQCHLLIWLNTHDITTELENKGEYYYPLIDLLL CRSKIIYARSEAIWCYEQAKSAYSDLEKYKQEFKEQKNNS |

TABLE 12-continued

| | |
|---|---|
| | IDSKFNNLNQWLQEIPEISFNYVDYLKDLELHKTTIQTNS<br>KNYRLYLEKLNKIGIGSDNLEFLSNFLELAEDTLVEQINT<br>NLAYLTPGQNLFDQMIGTIRGIVELEQAKRDRSLERTIQV<br>LGIAFGGGAIVSGVVTQHIDKPFAPQINFKYPVHPLVSSL<br>LWSVLATAIFGIVAWWVTKPKPKRNKQK |
| Hypothetical protein (SEQ ID NO: 440) | MSDYEITVNTFIHLLNTQSYLFSAEDRITLMKLINNQPDD<br>IKSLSDTISDWCAKHPEVDKALGEFEKIVVRGPGDKQANT<br>NIPKYELDKKNILNEIQQSSSSAKETKKTTST |
| tetratricopeptide repeat protein (SEQ ID NO: 441) | MLGERAENLEQAIACHQKAVKIYTLDAFPYEWASTQNNLG<br>AAYRDRILGEQAENLELVIACFQNALKIYTFEAFPDDWAN<br>TQDNLGTAYANRIKGEQAENLELAIAAYSAALEVRTRSNF<br>PEDWAMTQNNLGGAYSYRILGNRAENIELAIAACSAALEV<br>TTRSAFPEYWARTQYNLGIAYSQRILGEKTENIETAIAAY<br>SAALEVTTRSAFPIDWARTQNNLGGAYSQRILGEKAENIE<br>TAIAAYSVALEVYTRSAFPEYWAGTQYNLGIAYRQRILGN<br>RDENIELAIAAFSAALEVRTRSAFPEDWATTQNDLGIAYG<br>ERILGEKAENIELAIAAFSAALEVRTRSAFPVDWADKQNN<br>LGIAYTYRILGEKAENIELAIAAYSAALEVRTRSAFPENW<br>ATTQNNLGGAYSQRILGEKAENIELAIAAYSAALEVRTRS<br>AFPEDWAITQNNLGGAYTYRILGEKAENIETAIAAYSAAL<br>EVTTRSAFPEDWATTQNNLGIAYGERILGEKAENIELAIA<br>AYSVALEVTTRSAFPVDWASTQHNLGNAYLDRILGEKAEN<br>IESAIAAYSSALEVRTRSAFPEKWAGTQNSLGNAYLDRIL<br>GEKAENIELAIAAFSAALEVYTRSAFPENWAMTQTNLGGA<br>YRERIFGEKAENIESAITAYTAALEVRTRNAFPQNHATTL<br>LNLGRLYQDEKQLDSAYNTFLQAIETAETLRGGTVSGEEA<br>KRKQAEEWNQLYQRMVAVCLELGKDTEAIEYIERSKTRNL<br>VELILNRDLKTIFPPEVVTQLEQLRDEIATGQYQIQNGKA<br>ENPRLLAQHLQELRQQRNELQNRYLPVGYGFKFESFQATL<br>DERTAIIEWYILNDKILAFIVTKTGELTVWQSQPEDIKAL<br>VNWGNQYLQNYDDQKDQWLNSLGEELKELASILHIDEILT<br>QIPKHSYKLILIPHFFLHLFPLHALPINQNSENSSCLLDL<br>FAGGVSYAPSCQLLQQVQQRQRPDFQSLFAIQNPTEDLNY<br>TNLEVESILSYFPSHQVLSKKQATKAALSQAATQLKQANY<br>LHFSCHGSFNLNYPQNSFLLLADAYISPIPDDANPERYLK<br>VSDTEAIDLSKCLTLGNLFEQTFDFSQTRLVVLSACETGL<br>IDFNNTSDEYIGLPSGFLYAGSSSVVSSLWTVNDLSTSFL<br>MIKFIQILKNATDMSIPLGMNQAQRWLRDATKEELQEWVK<br>KLALDSTKKGKIRRQINNMTGEQPFNSPFHWAAFTAVGK |
| hypothetical protein (SEQ ID NO: 442) | MTYLEKLSPWCIVRLKPNMQNQIVARFRARSDAEAHLQVL<br>RRLIPGVSFTLIFNVGLEQQDLTAVNE |
| hypothetical protein (SEQ ID NO: 443) | MNPHPLKQREQDLMQLYSYCQLGMTPKQFYSKWQVNYEEM<br>AQICDRSLSTVRRWFARGKNYRRPMPVDLRHLALMNFLLE<br>HFEDIPEEVLQKLCFPEKSE |
| hypothetical protein (SEQ ID NO: 444) | MLKPVSYKTDQHRAYQQALDDFGITELLAKLNNYSDVDFD<br>SAWIQLQQQEIESLAAILISQLTYSLNGKLIAAYLNLIRH<br>SNQDIVPSLINLKCPDASIELPANFSDVAKTPRFLYGDRL<br>RWLSTESNTDWGIVIGRFYSNACDRCCWSWCYLIWLSKNS<br>PSAAWTSADIAWEEDLEPISEETEL |
| hypothetical protein (SEQ ID NO: 445) | MGKVTVTLYMEEEDKEALQFLADAEERSLSQMAVLIVKRA<br>IKQAQNDGKIPPKS |
| Hypothetical protein (SEQ ID NO: 446) | MKIEIQGRDAVKATEELLAIEGLEGSYQTIEEVEREGTLA<br>TIATIVGIVSGTLTIAESIHKWKEKNQKSLHDPTGARVEK<br>VLIVTDDNRRLLLKDATVEQIKEILENYK |
| CHAT domain-containing protein (SEQ ID NO: 447) | MKILHLYLKLVGDRYAQLRLFWDNPNNCQSRQLPLAEITG<br>LIKKVETDYYTRLPEDYAKTGQALYNWLDGSDRIFQSAID<br>QHKREVIVLAIAATEKLAHLPWEILHDSTDFLVNRRPFPI<br>IPIRWVKDDDSKQLTPEDQPANRALNVLFMATSPLGIEPE<br>LDFEAEEAQVLSATKRQPLSLIVEESGCLKELGYLVDDYD<br>KSYFDVIHLTGHTTFRDGEPRFITETELGQAEYSSAEDIA<br>TELQFQLPKLIFLSGCNTGYSSDAGAVPSMAEALLKQGAT<br>AVIGWGQRVLDTDAIATAAALYQELSAGKTLTEAIAIAYQ<br>VLLKNQARDWHLLRLYVAETLPGALVKRGRKPVPRASVAQ<br>EFLDPEKKLRVATRETFVGRRRQLQNCLRVLKPYSEKIGI<br>LIHGMGGLGKSTIAARLCDRLSESEKIIGWRQIDESSLVS<br>KLADKLRNAELRTALREGKEELKYRLRDVFAELNQSGEKP<br>FLLVFDDFEWNLEHRQGRYILKTQVAEILKSLVWAIKENN<br>ADHRIIITCRYDFESDLDESFYKQPLESFRKSDLQKKLSR<br>LKAFNSEEISLNLIERAKILADGNPRVLEWLNDEVLLGED<br>AETKLTQLKANPTEWQGRIIWEELYEQLDQDIEQILSRCL<br>VFEIPVPMIALSAVCESTSDYKKQLSRAIELGLIEVSSEA<br>EESNRLYRVSRIIPHIIPNIRLPEAPEVYCLYQKAYEKLH |

| | |
|---|---|
| | QMWGDKNNRSEEKWQEIFRLKFANKDNPERFRQGFSQMLA VQDNSEADKAFESELRKCTNELEADKLCEALENYLQQEQW KQADKETAWTFYQVMVKENYADWHELLKNFPCETLQEINR LWLENSNNKFGISIQSKIYQSLTGKDNSWNKFCDLVGWRK RGKSQTYNEIVDELTDIKRVVNDTFADVHVPSLPALIYTR LGDGWTTSMGWTVGDERPGFGGFGFLVVACGIENLFSLAE SCKD |
| restriction endonuclease subunit S (SEQ ID NO: 448) | MKIESFFVNFELLTDAPNAVAKLREIILQLAVRGKLVSQK PNDEPALSSLNRAKIENEFFQQTEIFARDELDSFCPNNRS LATIPHRWEWVSLVEVVDKGKNSIKRGPFGSSIRKEFFVP DGYKVYEQKNAIYDDFQLGYYFINEKKFQELKDFELKPND IIISCSGTIGRIAVAPESIRQGIINQALLKITLNTKLLSN NYFKILFPAFFMNTSVLTELKGTAIKNIVGVQALKQLLFP LPPIAEQKRIVEKCDRLLSICDEIEKRQQQRQESILRMNE SAIAQLLSSQNPDEFRQHWQRIRNNFDLFYSVPETIPKLR QAILQLAVQGKLVRQEFDESALRYLIERITEERLALCPNE KDKQRILSEFGKIIEESAQGKTEEFEIPAICICDFITKGT TPSNSELLPEGEIPYLKVYNIVDNKIDFFYKPTYISRTVH TTKLKRSLVCPGDVLMNIVGPPLGKIAIVPDDFPEWNINQ ALAVFRPVDSVYNRFMYYALSSYATLEKVLNETKGTAGQD NLSLEQCRSLRIPLYTIETQKRIVEKCDRLMSLCDTLEAK LKQGRDSSEKLMEVAAKQVLTA |
| SAM-dependent DNA methyltransferase (SEQ ID NO: 449) | MSISTTIKTIQDIMRKDAGVDGDAQRINQLVWMIFLKVFD AREEEYELLEDNYQSPIPEGLRWRNWAADSEGITGDGLLD FVDNALFKTLKELRTTATDARGQMIGKVFEDAYNYMKNGT LIRQVINKLNEVDFNKKDQKKQFSEIYEKILKDLQSAGNA GEYYTPRAVTKFIVDRIKPQLGEIVFDPACGTGGFLTAAI DYIRQNFQSADVPETLQRTIRGTEKKPLPFNLCVTNLILH GIDVPSAEHDNTLARPLRDYSPHERVDVIITNPPFGGMEE DGIEDNFPATFRTRETADLFLVLIAHLLKEGGRGAIVLPD GTLFGEGVKTRIKEKLLQDCNLHTIVRLPNGVFNPYTSIK TNLLFFTKGEPTERIWYYEHPYPAGYKSYSKTKPIRFEEF APEQEWWDNREKNEFAWQVSIADLKANNYNIDIKNPHKVD VEHADLDEMLAEHQKLMAELGEVRSKLKFELIEALEIDED |
| DEAD/DEAH box helicase (SEQ ID NO: 450) | MPEAIDKKSLSERDICTKYITPALTNRAWDINTQIREEVT LTKGRVIVRGKLASRGEQKRADYVLYHKPGVPLAVIEAKD NNHGVSAGMQQAIATGELIDVPFIFSSNGDAFMMCDRTIT EGQREREIPLEQFPTPQELWQKYCDWKGIDSEIQPIVSQD YYPSSDKKQPRYYQQIAINRTIEAIAKGENRILLVMATGT GKTFTAFQIIWRLWKSGAKKRILFLADRNILVDQTRVNDF KPFGSRMTKIQKRQIDKSYEIYLCLYQAVTGNEEAKNIYR QFSPDFFDLIIIDECHRGSANEDSAWREILEYFRNATQIG LTATPRETEEASNINYFGESLFTFYSLKQGIEDGFLAPYKV IRIDLDKDLSGWKPKPGQRDKYGKPIPDQVYNQRDFDRTL VLEKRTELVARIISDYLKSSDRFAKTIIFCETTDHAERMR VALVNENADLVAGNSRYIMRITGDDAQGKAELDNFIDPES KYPTIVTTSELLTTGVDAKTCKLIVLDQRILSMTKFKQII GRGTRIDEDYGKMFFTIMDFKKATELFADPDFDGDPVQIY QPKPVDPIVPPDTGDDEVVIDDGEISRKQTRDRYVIADEE VSIAFIREQYYGKDGKLITESIKDYTRKTVSQEYASLDAF LKKWHSTEQKQAIIRELQELGVPLEALEKEIGRDFDPLDL ICHVVFDQPPLTRKERANNVRKRNYFSNYGEQARTVLNAL LDKYADEGIEDIESLDVLKVQPISDLGTPLEIISIFGGKQ AYLQALSVLKSEIYRVS |
| MerR family transcriptional regulator (SEQ ID NO: 451) | MEGKFYTSTEAAQITNCSRRQLQYWRDKGVVVPTVNTTGK GRNVYYSISDLLVLTVMHYLLSVGLSFEVSRQTLVILRQK EPWLFEEFVPKEKMKRLMLLTTCSLEQPLTLAEFDKEAAL EALCQGQTVIPFWCDRIHQQLRDNLKSFSS |
| C2c5 WP_029636312.1 (SEQ ID NO: 947) | MSQITIQARLISFESNRQQLWKLMADLNTPLINELLCQLG QHPDFEKWQQKGKLPSTVVSQLCQPLKTDPRFAGQPSRLY MSAIHIVDYIYKSWLAIQKRLQQQLDGKTRWLEMLNSDAE LVELSGDTLEAIRVKAAEILAIAMPASESDSASPKGKKGK KEKKPSSSSPKRSLSKTLFDAYQETEDIKSRSAISYLLKN GCKLTDKEEDSEKFAKRRRQVEIQIQRLTEKLISRMPKGR VDLTNAKWLETLLTATTTVAEDNAQAKRWQDILLTRSSSLP FPLVFETNEDMVWSKNQKGRLCVHFNGLSDLIFEVYCGNR VQLHWFQRFLEDQQTKRKSKNQHSSGLFTLRNGHLVWLEGE GKGEPWNLHHLTLYCCVDNRLWTEEGTEIVRQEKADEITK FITNMKKKSDLSDTQQALIQRKQSTLTRINNSFERPSQPL VYQGQSHILVGVSLGLEKPATVAVVDAIANKVLAYRSIKQL LGDNYELLNRQRRQQYLSHERHKAQKNFSPNQFGASELG VQHIDRLLAKAIVALARTYKAGSIVLPKLGDMREVVQSEIQ AIAEQKFPGYIEGQQKYAKQYRVNVHRWSYGRLIQSIQSK AAQTGIVIEEGKQPIRGSPHDKAKELALSAYNLRLTRRS |

TABLE 12-continued

| | |
|---|---|
| C2c5 DR (SEQ ID NO: 452) | GTGGCAACAACCTTCCAGGTACTAGGTGGGTTGAAAG |
| C2c5 DR (SEQ ID NO: 453) | GTGGCAACAACCTTCCAGGTACTAGGTGGGTTGAAAG |
| C2c5 DR (SEQ ID NO: 454) | GTGGCAACAACCTTCCAGGTACTAGGTGGGTTGAAAG |
| C2c5 DR (SEQ ID NO: 455) | GTGGCAACAACCTTCCAGGTACTAGGTGGGTTGAAAG |
| C2c5 DR (SEQ ID NO: 456) | GTGGCAACAACCTTCCAGGTACTAGGTGGGTTGAAAG |
| C2c5 DR (SEQ ID NO: 457) | GTGGCAACAACCTTCCAGGTACTAGGTGGGTTGAAAG |
| C2c5 DR (SEQ ID NO: 458) | GTGGCAACAACCTTCCAGGTACTAGGTGGGTTGAAAG |
| C2c5 DR (SEQ ID NO: 459) | GTGGCAACAACCTTCCAGGTACTAGGTGGGTTGAAAG |
| C2c5 DR (SEQ ID NO: 460) | GTGGCAACAACCTTCCAGGTACTAGGTGGGTTGAAAG |
| Transposase (SEQ ID NO: 461) | MLVFEAKLEGTKQQYEQLDEAIRTARFIRNSCIRYWMDNP<br>YIGRYELSAYCVVLQREFPFANKLNSMARQASAERAWSAI<br>ARFYDNCKKKAAKKGFPRFKKHQTHGSVEYKTCGWKLSED<br>RRTITFTDGFKAGSFKMWGTRDLHFYQLKQIKRVRAVRRA<br>DGYYVQFCLDVERVEKREPTGKTIGLDVGLAHFYTDSDGK<br>TVENPRHLRKSEKALNALGRRLSRTTKGSKNRAKSRNRLS<br>RKHLKVSRQRKDFAVKLARCVIQSNDLVAYEDLQVRNMVK<br>NRKLSKSISDAAWSAFRNWLEYFGKVFGVATVAVPPHYTS<br>QNCSKCGEVIKKSLSQRTHKCHQCGLVLDTDWNAARNILE<br>LALRTVGHTGTLNASGDISLCMSEEIPSSKLSRGKRKPKE |

In one embodiment, a TnsB protein may be the protein defined at Accession No. WP_084763316.1. In another embodiment, a TnsC protein may be the protein defined at Accession No. WP 029636336.1. In another embodiment, a TniQ protein may be the protein defined at Accession No. WP 029636334.1. In another embodiment, a Cas12k protein may be the protein defined at Accession No. WP 029636312.1.

Another method for C2c5 PAM discovery is to use activated C2c5. A plasmid library comprising a target sequence flanked on the 5' or 3' side with 8nt of randomized sequences is incubated with C2c5 crRNA complexes. PAM sequences are determined by identifying by sequencing target-containing plasmids to identify depleted 8 bp sequences.

TABLE 13

| | |
|---|---|
| tracrRNA_1 (SEQ ID NO: 462) | aaauacagucuugcuuucugacccugguagcugcucacccugaugcugcugu-caaua<br>gacaggauaggugcgcucccagcaauaagggcgcggauguacugcuguaguggc-uac<br>ugaaucacccccgaucaagggggaacccuc |
| tracrRNA_2 (SEQ ID NO: 463) | aaauacagucuugcuuucugacccugguagcugcucacccugaugcugcugu-caaua<br>gacaggauaggugcgcucccagcaauaagggcgcggauguacugcuguaguggc-uac<br>u |
| tracrRNA_3 (SEQ ID NO: 464) | agacaggauaggugcgcucccagcaauaagggcgcggauguacugcu-guaguggcua<br>cugaaucacccccgaucaagggggaacccucc |
| tracrRNA_4 (SEQ ID NO: 465) | aggugcgcucccagcaauaagggcgcggauguacugcuguaguggcuacugaau-cac<br>ccccgaucaagggggaacccuccc |

PAM Determination

One method to determine the PAM sequence of a Tnf7-associated CRISPR-Cas is by purifying Cas5678f complexes, and incubating the complexes with a guide directed to a plasmid library where the target sequence is flanked either on the 5' or 3' side with 8nt of randomized sequences. DNA bound to the Cas5678f+crRNA complexes is separated and sequenced to reveal a sequence motif that promotes the Cas5f-8f complex with its target DNA. To determine PAM sequences for c2c5, a similar screen is performed substituting C2c5 for Cas5678f complexes.

C2c5 Catalytic Residues

To activate C2c5, catalytic residues are introduced to restore nuclease activity. Candidate residues for substitution can be identified by comparison to homologous Cas12 proteins.

tracrRNA Determination

Transcripts were sequenced and mapped at the C2c5 locus and putative tracrRNAs identified. (FIG. 4A, B). FIG. 4C depicts a predicted structure of tracrRNA_1 with crRNA of the direct repeat.

Figure 5:
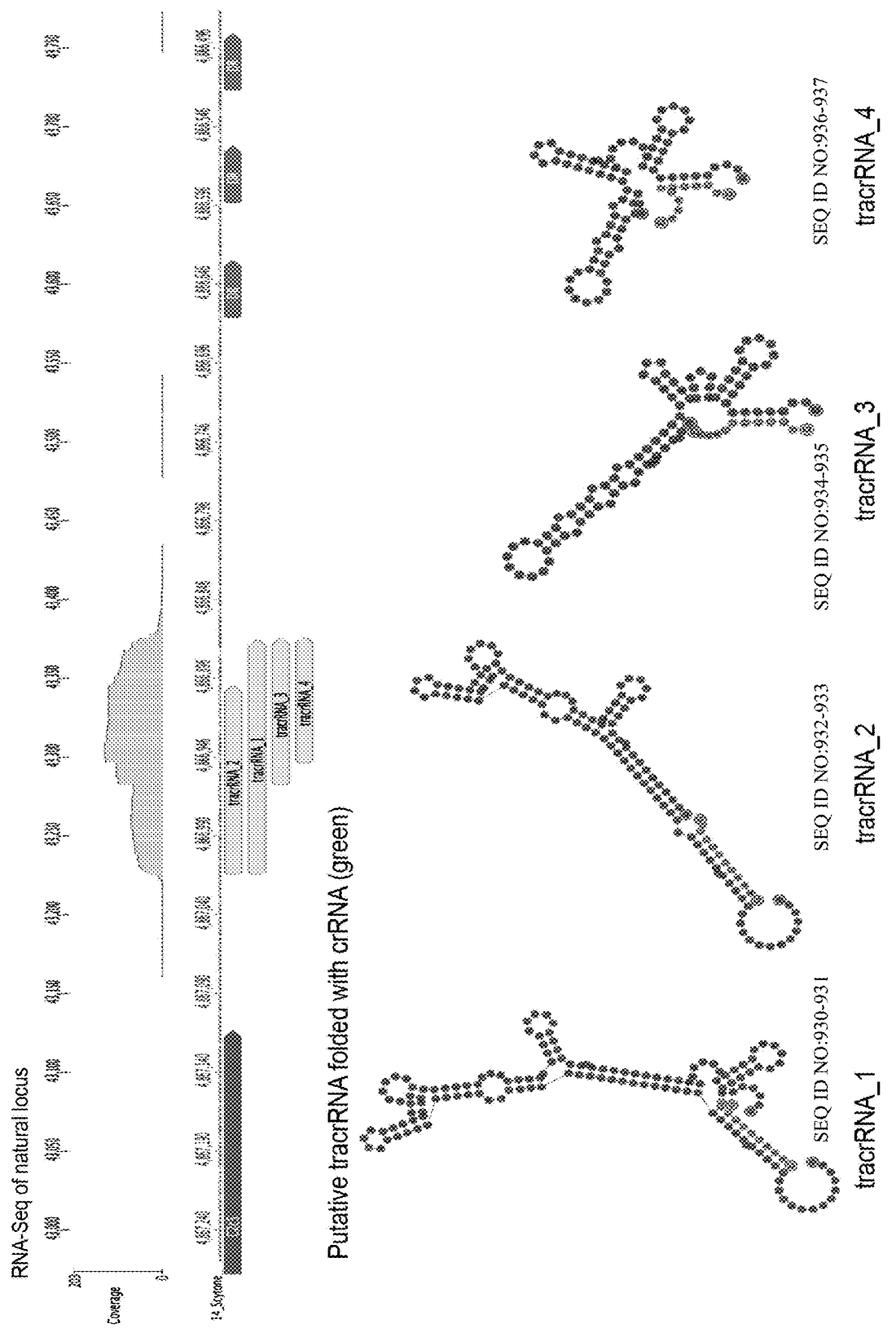
FIG. 5. RNA sequencing from the natural locus in Cyanobacteria and folding of four tracrRNAs with crRNA (SEQ ID NO:930-937).

Putative tracrRNAs 1-4 were folded with crRNA comprising the sequence guggguugaaag (FIG. 5).

Example 2—Insertions in *E. coli* and PAM Preference

To generate insertions in *E. coli*, TnsB, TnsC, TniQ, and C2c5 are expressed from a pUC19 plasmid along with the endogenous tracrRNA region and a crRNA targeting FnPSP1 (FIG. 6A). An R6K donor plasmid contains the t14 left and right transposon ends with a kanamycin resistance cargo gene (FIG. 6A). The target plasmid contains the FnPSP1 target adjacent go a 6N PAM library (FIGS. 6A, 6B).

Figure 7:
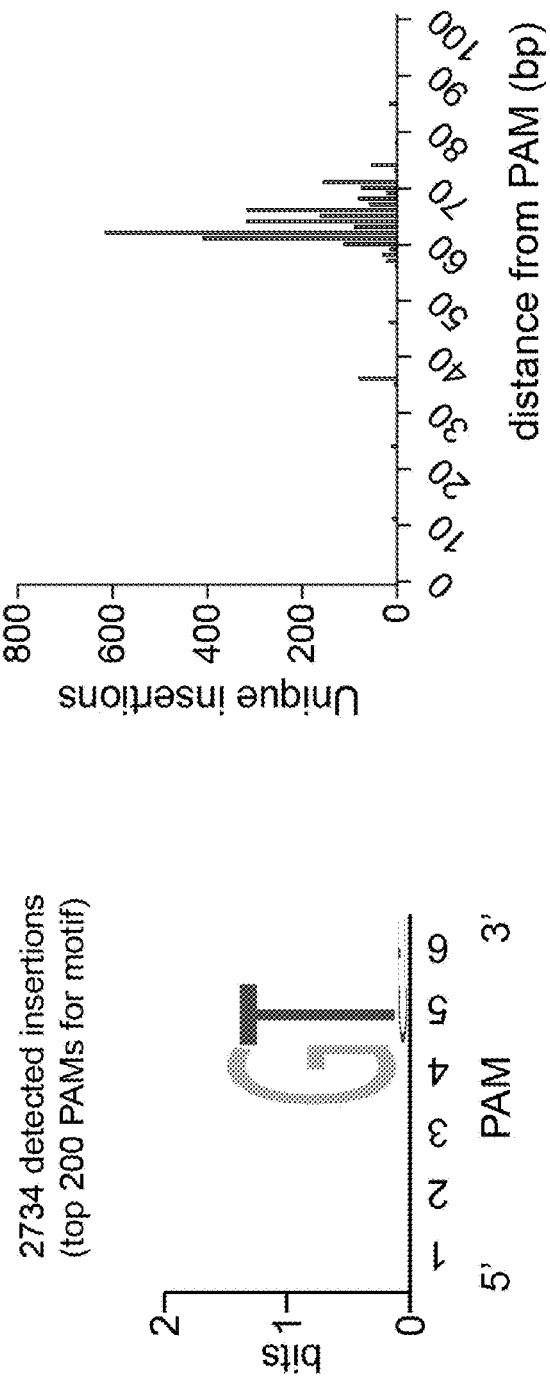
FIG. 7. Deep sequencing of insertions into a PAM library revealing a GTN PAM preference for t14_C2c5 (UTEX B 2349) and the location of insertions downstream of the target.

Insertions into the PAM library were deep sequenced revealing a GTN PAM preference of t14_C2c5 and confirming the location of insertions downstream of the target (FIG. 7).

Nucleotide sequences of the pUC19_t14 plasmid, expressing TnsB, TnsC, TniQ, C2c5 and FnPSP1 crRNA, and the R6K_t14_KAN_donor plasmid are set forth in the table below.

TABLE 14

| pUC19_t14_helper (SEQ ID NO: 466) | gttgcaggaccacttctgcgctcggcccttccggctggctggtttattgctgataaatct
ggagccggtgagcgtgggtctcgcggtatcattgcagcactggggccagatggtaagccc
tcccgtatcgtagttatctacacgacggggagtcaggcaactatggatgaacgaaataga
cagatcgctgagataggtgcctcactgattaagcattggtaactgtcagaccaagtttac
tcatatatactttagattgatttaaaacttcattttttaattttaaaaggatctaggtgaag
atcctttttgataatctcatgaccaaaatcccttaacgtgagttttcgttccactgagcg
tcagaccccgtagaaaagatcaaaggatcttcttgagatccttttttctgcgcgtaatc
tgctgcttgcaaacaaaaaaaccaccgctaccagcggtggtttgtttgccggatcaagag
ctaccaactcttttccgaaggtaactggcttcagcagagcgcagataccaaatactgtt
cttctagtgtagccgtagttaggccaccacttcaagaactctgtagcaccgcctacatac
ctcgctctgctaatcctgttaccagtggctgctgccagtggcgataagtcgtgtcttacc
gggttggactcaagacgatagttaccggataaggcgcagcggtcgggctgaacggggggt
tcgtgcacacagcccagctggagcgaacgacctacaccgaactgagatacctacagcgt
gagctatgagaaagcgccacgcttcccgaagggagaaaggcggacaggtatccggtaagc
ggcagggtcggaacaggagagcgcacgagggagcttccagggggaaacgcctggtatctt
tatagtcctgtcgggtttcgccacctctgacttgagcgtcgattttttgtgatgctcgtca
gggggcggagcctatggaaaaacgccagcaacgcggccttttacggttcctggcctt
tgctggccttttgcTcaACGCCAAGCTCCAAAACGATCTCAAGAAGATCATCTTATTAAt
tttacactttatgcttccggctcgtatgttgaaagaggagaaaggatctatgaacagtca
gcaaaatcctgatttagctgttcatcccttggcaattcctatggaaggcttactaggaga
aagtgctacaactcttgagaagaatgtaattgccacacaactctcagaggaagcccaagt
aaagctagaggtaatccaaagtttactggaaccctgcgatcgcacaacttatgggcaaaa
gttgcgggaagcagcagagaaactaaatgtatcgttgcgaacggtacaaaggttggtgaa
aaactgggaacaagatggcttagtcggactcactcaaacaagtagggcgtgataaaggaaa
acaccgcattggtgagttttgggaaaacttcattaccaaaacctacaaggagggtaacaa
gggaagtaaacgtatgaccctaaacaagttgctctcagagtcgaggctaaagcccgtga
attaaaagactctaagccgcccaattacaaaaccgtgttacgggtattagcacccatttt
ggaaaagcaacaaaaagccaagagtatccgcagtcctggttggagaggaactacgctttc
ggttaaaacccgtgaaggaaaagatttatcggttgattacagtaaccatgtttggcaatg
tgaccatacccgcgtggatgtgttgctggtagatcaacatggtgaaattttaagtcgtcc
ctggctaacaacagtaattgatacttactctcgttgcattatgggtatcaacttgggctt
tgatgcacccagttctggggtagtagcattagcgttacgccatgcaattctaccaaagcg
ttacggttccgagtacaaactgcattgtgagtggggaacctatggaaaaccagaacattt
ttatactgatggcggtaaagactttcgctctaaccacttgagtcagattggggcgcaatt
gggatttgtctgtcatttacgcgatcgccttctgaaggtggagtagtagaacgtccctt
caaaacattaaatgaccaactattttcaacgcttcctgggtacaccggatctaatgtgca
ggaacgcccagaagatgcagagaaggacgcaagacttactttgcgagaactagaacagtt
acttgtgcgttacatcgtagatcgttacaaccaaagtattgatcgcggatgggcgacca
aacgcgctttgagcgttgggaagcaggattgcctacagtgccagtaccaataccagaacg
agatttggatatttgtttaatgaagcagtcacggcgcactgtgcaaagaggtggttgttt
gcagtttcagaatttaatgtatcgggggggaatatttggcaggttatgccggagaaactgt
caacttaaggtttgaccccagagacattacaacaatttttggtttatcgccaggaaaacaa
tcaggaagtatttctgactcgcgctcacgctcaaggtttggagacagagcaactggcatt
agatgaggctgaggcagcaagtcgcagactccgtaccgcaggaaaactatcagtaacca
atcattattgcaagaagttgttgaccgcgatgctcttgtcgctaccaagaaaagccgtaa
ggagcgtcaaaaattggaacagactgttttgcgatctgctgctgttgatgaaagtaatag
agaatccttgccttctcaaatagttgaaccagatgaagtggaatctacagaaacggttca
ctctcaatacgaagacattgaggtgtgggactatgaacaacttcgtgaagaatatgggtt
ttaaacaatgacagaagctcaggcgatcgccaagcagttgggtggggtaaaaccggatga
tgagtggttacaagctgaaattgctcgtctcaagggtaagagcattgtgcctttacagca
ggtaaaaactctccatgattggttagatggcaagcgcaaggcaagaaaatcttgccgagt
agttggggaatcgagaactggcaagacagttgcttgtgatgcctacagatacaggcacaa
acctcagcaggaagctggacgacctccaactgtgcctgtcgtttatattcgacctcacca
aaaatgtggccccaaggatttgtttaaaaagattactgagtacctcaagtatcgggtaac
aaaagggactgtatctgattttcgagataggacgatagaagtactcaagggttgtggcgt
agagatgctaattattgatgaagctgaccgtctcaagcctgaaacttttgctgatgtgcg
agatattgccgaagatttaggaattgctgtggtactggtaggaacagaccgtttggatgc
ggtaattaagcgggatgagcaggttctcgaacgctttcgggcgcatcttcgctttggtaa
attgtcgggagaggattttaagaacaccgtagaaatgtgggaacaaatggttttgaaact
gccagtatcttctaatctaaagagcaaggagatgctacggattcttcacgtcagcaactga
aggctacattggtcgccttgatgagattcttagggaagctgcaattcgttccttatcaag
aggattgaagaagattgacaaggctgttttacaggaagtagctaaggagtacaaatgata
gaagcaccagatgttaaaccttggctattcttgattaaaccctatgaaggggaaagcctg
agccactttcttggcaggttcagacgtgccaaccatttatccgcaagtggattgggtact
ttggcaggaattggtgctatagtggcacgttgggaaagatttcattttaatcctcgccct
agtcagcaagaattggaagcgatcgcatctgtagtagaagtggatgctcaaaggttagcc |

TABLE 14-continued

```
                   cagatgttaccgcctgctggagtgggaatgcagcatgagccaattcgcttgtgtgggget
                   tgttatgccgagtcgccttgtcaccgaattgaatggcagtacaagtcggtgtggaagtgc
                   gatcgccatcaactcaagattttagcaaagtgtccaaactgtcaagcacctlttaaaatg
                   cctgcgctgtggaggatgggtgctgtcacagatgtaggatgccgtttgcagaaatggca
                   aagctacagaaggtttgatgataaaaccagaaaaaggtgtgaaattaactaagtccctga
                   attgatctggttgtccaaaaaatttgtgcgatcgcatggcaagattattcctactattga
                   tgtggcgtgagtcggataacttgctctaatgctgataaaaccagaaaaaggtgtgaaatt
                   aactaagtccctgaattgatctggttgtccaaaaaatttgtgcgatcgcatggcaagatt
                   attcctactattgatgtggtttacactttatgcttccggctcgtatgttgaaagaggaga
                   aggatctatgagtcaaataactattcaagctcgacttatttcctttgaatcaaaccgcc
                   aacaactctggaagttgatggcagatttaaacacgccgttaattaacgaactgctttgcc
                   agttaggtcaacaccccgacttcgagaagtggcaacaaaagggtaaactcccgtctaccg
                   ttgtgagccagttatgtcaacctctcaaaactgaccctcgctttgcaggtcagcccagcc
                   gtttatatatgtcggcaattcatattgtggactacatctacaagtcctggctggctatac
                   agaaacggcttcaacagcagctagatggaaagacgcgctggctagaaatgctcaatagcg
                   atgctgaattagtagaacttagtggtgacacttagaggctattcgtgtcaaagctgctg
                   aaattltggcaatagctatgccagcatctgagtcagatagcgctthaccthaaaagggaaaa
                   aaggtaaaaggagaaaaaaccctcatcttctagccctaagcgtagtttatccaagacat
                   tatttgacgcttaccaagaaacggaagatatcaagagccgtagcgccatcagctacctgt
                   taaaaaatggctgcaaacttactgacaaagaagaagattcagaaaaaatttgctaaacgtc
                   gtcgtcaagttgaaatccaaattcaaaggcttaccgaaaagttaataagtcggatgccta
                   aaggtcgagatttgaccaatgctaaatggttggagacactcttgactgctacaaccactg
                   ttgctgaagacaacgcccaagccaaacgctggcaggatattctgttaactcgatcaagtt
                   ctctcccattccccttgtttttgaaaccaacgaggatatggtttggtcaaagaatcaaa
                   agggtaggctgtgtgttcacttcaatggcttaagcgatttaattttttgaggtgtactgcg
                   gcaatcgtcaacttcactggtttcaacgcttcctagaagaccaacagactaaacgcaaaa
                   gcaaaaatcagcattctagcggcttgttcacactcagaaatggtcatctagtttggcttg
                   aaggtgagggtaaaggggaaccttggaatcttcaccacttgacccttttactgctgtgttg
                   acaatcgcttgtggacagagggaggggaacagaaatcgttcgccaagagaaagcagatgaaa
                   ttactaaattcatcacaaacatgaagaagaaagcgatctaagcgatacacagcaagctt
                   tgattcaacgtaaacaatcaacacttactcgaataaacaattcctttgagcgtcctagcc
                   aacccctttatcaaggtcaatcacacattttggttggagtaagcctgggactagaaaaac
                   ctgccacagtagcagtagtagatgcgatcgccaacaaagtcttggcttaccggagtatta
                   aacaattacttggcgacaattacgaactgctaaatcgccagagacgacaacagcagtacc
                   tatctcacgaacgccacaaagcacaaaaaaacttctctcccaatcaatttggagcatctg
                   agttagggcaacatatagacagattattagctaaagcaattgtagcgttagcgagaacct
                   acaaagctggcagtattgtcttgcccaagttaggggatatgcgggaggttgtccaaagtg
                   aaattcaagctatagcagaacaaaaatttcccggttatattgaaggtcagcaaaaatatg
                   ccaaacagtaccgggttaatgttcatcggtggagctacggcagattaattcaaagcattc
                   aaagtaaagcagctcaaacaggaattgtgattgaggagggaaaacaacctattcgaggta
                   gtccccacgacaaagcaaaggaattagcactttctgcttacaatctccgcctaactaggc
                   gaagttaacaaatatctgaaccttgataatagaatattaatagcgccgcaattcatgctg
                   cttgcagcctctgaattttgttaaatgagggttagtttgactgtataaatacagtcttgc
                   tttctgaccctggtagctgctcaccctgatgctgctgtcaatagacaggataggtgcgct
                   cccagcaataagggcgcggatgtactgctgtagtggctactgaatcaccccgatcaagg
                   gggaaccctccccaattcttcatttgaaggactaaaatcaaggcaaaatttctaagagat
                   ccgcgcaagttccaaatacctatctcgtcttgatttcatcttttttttaaccaaggcatg
                   attcttgagactgaggctcaaatgagaaattgggaaacatccgcgctgaagatatctgga
                   aaggttggctcacaacattttgtaactgggtagttgacagctagctcagtcctaggtata
                   atgctagcgtggcaacaaccttccaggtactaggtgggttgaaagGAGAAGTCATTTAAT
                   AAGGCCACTGTTAAAAgtggcaacaaccttccaggtactaggtgggttgaaagcggccga
                   cgcgctgggctacatggtgcactctcagtacaatctgctctgatgccgcatagttaagcc
                   agccccgacacccgccaacacccgctgacgcgccctgacgggcttgtctgctcccggcat
                   ccgcttacagacaagctgtgaccgtctccgggagctgcatgtgtcagaggttttcaccgt
                   catcaccgaaacgcgcgagacgaaagggcctcgtgatacgcctattttttataggttaatg
                   tcatgataataatggtttcttagacgtcaggtggcacttttcggggaaatgtgcgcggaa
                   ccccctatttgtttattttttctaaatacattcaaatatgtatccgctcatgagacaataac
                   cctgataaatgcttcaataatattgaaaaaggaagagtatgagtattcaacatttccgtg
                   tcgcccttattccctttttttgcggcattttgccttcctgtttttgctcacccagaaacgc
                   tggtgaaagtaaaagatgctgaagatcagttgggtgcacgagtgggttacatcgaactgg
                   atctcaacagcggtaagatccttgagagttttcgccccgaagaacgttttccaatgatga
                   gcacttttaaagttctgctatgtggcgcggtattatcccgtattgacgccgggcaagagc
                   aactcggtcgccgcatacactattctcagaatgacttggttgagtactcaccagtcacag
                   aaaagcatcttacggatggcatgacagtaagagaattatgcagtgctgccataaccatga
                   gtgataacactgcggccaacttacttctgacaacgatcggaggaccgaaggagctaaccg
                   cttttttgcacaacatgggggatcatgtaactcgccttgatcgttgggaaccggagctga
                   atgaagccataccaaacgacgagcgtgacaccacgatgcctgtagcaatggcaacaacgt
                   tgcgcaaactattaactggcgaactacttactctagcttcccggcaacaattaatagact
                   ggatggaggcggataaa R6K_t14_KAN_donor  tggtttcttagacgtcaggtggcacttttcggggaaatgtgcgcggaaccccctatttgtt
(SEQ ID NO: 467)   tatttttctaaatacattcaaatatgtatccgctcatgagacaataaccctgataaatgc
                   ttcaataatattgaaaaaggaagagtatgagtattcaacatttccgtgtcgcccttattc
                   cctttttttgcggcattttgccttcctgtttttgctcacccagaaacgctggtgaaagtaa
                   aagatgctgaagatcagttgggtgcacgagtgggttacatcgaactggatctcaacagcg
                   gtaagatccttgagagttttcgccccgaagaacgttttccaatgatgagcacttttaaag
                   ttctgctatgtggcgcggtattatcccgtattgacgccgggcaagagcaactcggtcgcc
                   gcatacactattctcagaatgacttggttgagtactcaccagtcacagaaaagcatctta
                   cggatggcatgacagtaagagaattatgcagtgctgccataaccatgagtgataacactg
                   cggccaacttacttctgacaacgatcggaggaccgaaggagctaaccgcttttttgcaca
```

TABLE 14-continued

```
acatgggggatcatgtaactcgccttgatcgttgggaaccggagctgaatgaagccatac
caaacgacgagcgtgacaccacgatgcctgtagcaatggcaacaacgttgcgcaaactat
taactggcgaactacttactctagcttcccggcaacaattaatagactggatggaggcgg
ataaagttgcaggaccacttctgcgctcggcccttccggctggctggttttattgctgata
aatctggagccggtgagcgtgggtctcgcggtatcattgcagcactggggccagatggta
agccctcccgtatcgtagttatctacacgacggggagtcaggcaactatggatgaacgaa
atagacagatcgctgagataggtgcctcactgattaagcattggtaactgtcagaccaag
tttactcatatatactttagattgatttaaaacttcattttaatttaaaaggatctagg
tgaagatccttttttgataatctcatgaccaaaatcccttaacgtgagttttcgttccact
gagcgtcagacccccgtagaaaagatcaaaggatcttcttgagatccttttttctgcgcg
taatctgctgcttgcaaacaaaaaaaccaccgctaccagcggtggtttgtttgccggatc
aagagctaccaactcttttccgaaggtaactggcttcagcagagcgcagataccaaata
ctgtccttctagtgtagccgtagttaggccaccacttcaagaactctgtagcaccgccta
catacctcgctctgctaatcctgttaccagccggttgtcagccgttaagtgttcctgtgt
cactcaaaattgctttgagaggctctaagggcttctcagtgcgttacatccctggcttgt
tgtccacaaccgttaaaccttaaaagctttaaaagccttatatattcttttttttctttat
aaaacttaaaaccttagaggctatttaagttgctgatttatattaatttatttattgttcaaa
catgagagcttagtacgtgaaacatgagagcttagtacgttagccatgagagcttagtac
gttagccatgagggtttagttcgttaaacatgagagcttagtacgttaaacttgagagct
tagtacgtgaaacatgagagcttagtacgtactatcaacaggttgaactgcccatgttct
ttcctgcgttatcagagcttatcggccagcctcgcagagcaggattcccgttgagcaccg
ccaggtgcgaataagggacagtgaagaaggaacaccccgctcgcgggtgggcctacttcac
ctatcctgcccggctgacgccgttggatacaccaaggaaagtctacacgaaccctttggc
aaaatcctgtatatcgtgcgaaaaaggatggatataccgaaaaaatcgctataatgaccc
cgaagcagggttatgcagcggaaagtaaaaaattttttagtttattagacatctccacaaa
aggcgtagtgtacagtgacaaattatctgtcgtcggtgacagattaatgtcattgtgact
atttaattgtcgtcgtgacccatcagcgttgcttaattaattgatgacaaattaaatgtc
atcaatataatgctctgcaattattatacaaagcaattaaaacaagcggataaaagga
cttgctttcaacccacccctaagtttaatagttactgagggggatccactagtgagctca
tgcatgatctcgaattagcttcaaaagcgctctgaagttcctatactttctagagaatag
gaacttcggaataggaacttcaagatcccctgattccctttgtcaacagcaatggataat
tcgatttaacaaatgcatggcgcaagggctgctaaaggaagcggaacacgtagaaagcca
gtccgcagaaacggtgctgaccccggatgaatgtcagctactgggctatctggacaaggg
aaaacgcaagcgcaaagagaaagcaggtagcttgcagtgggcttacatggcgatagctag
actgggcggtttatggacagcaagcgaaccggaattgccagctggggcgccctctggta
aggttgggaagccctgcaaagtaaactggatggctttcttgccgccaaggatctgatggc
gcaggggatcaagatctgatcaagagacaggatgaggatcgtttcgcatgattgaacaag
atggattgcacgcaggttctccggccgcttgggtggagaggctattcggctatgactggg
cacaacagacaatcggctgctctgatgccgccgtgttccggctgtcagcgcaggggcgcc
cggttcttttgtcaagaccgacctgtccggtgcctgaatgaactgcaggacgaggcag
cgcggctatcgtggctggccacgacgggcgttccttgcgcagctgtgctcgacgttgtca
ctgaagcgggaagggactggctgctattgggcgaagtgccggggcaggatctcctgtcat
cccaccttgctcctgccgagaaagtatccatcatggctgatgcaatgcggcggctgcata
cgcttgatccggctacctgcccattcgaccaccaagcgaaacatcgcatcgagcgagcac
gtactcggatggaagccggtcttgtcgatcaggatgatctggacgaagagcatcagggc
tcgccgccagccgaactgttcgccaggctcaaggcgcgcatgcccgacggcgaggatctcg
tcgtgacccatggcgatgcctgcttgccgaatatcatggtggaaaatggccgcttttctg
gattcatcgactgtggccggctgggtgtggcggaccgctatcaggacatagcgttggcta
cccgtgatattgctgaagagcttggcggcgaatgggctgaccgcttcctcgtgctttacg
gtatcgccgctcccgattcgcagcgcatcgccttctatcgccttcttgacgagttcttct
gaattgaaaaaggaagagtatgaggatccaacatttccaatcactagtgaattatctaga
attattccattgagtaagtttttaagcacatcagcttcaaaagcgctctgaagttcctat
actttctagagaataggaacttcggaataggtacttcaagatccccaattcgagatcgtc
cgggccgcaagctcctagcggcggatttgtcctactcaggagagcgttcaccgacaaaca
acagataaaacgaaaggcccagtctttcgactgagccttttcgttttatttgatgcctcaa
gctagagagtcattacccaggcgtttaagggcaccaataactgccttaaaaaaattacg
ccccgccctgccactcatcgcagtctagcttggattctcaccaataaaaaacgcccggcg
gcaaccgagcgttctgaacaaatccagatggagtctgaggtcattactggatctatcaa
caggagtccaagctcagctaattaaggcgacagtcaatttgtcattatgaaaatacacaa
aagcttttttcctatcttgcaaagcgacagctaatttgtcacaatcacggacaacgacatc
tattttgtcactgcaaagaggttatgctaaaactgccaagcgctataatctatactgta
taaggattttactgatgacaataatttgtcacaacgacatataattagtcactgtacacg
tagagacgtagcaatgctacctctctacaatggttttgtatggtgcactctcagtacaat
ctgctctgatgccgcatagttaagccagccccgacacccgccaacacccgctgacgcgcc
ctgacgggcttgtctgctcccggcatccgcttacagacaagctgtgaccgtctccgggag
ctgcatgtgtcagaggttttcaccgtcatcaccgaaacgcgcgagacgaaagggcctcgt
gatacgcctattttataggttaatgtcatgataataa
```

Example 3—PAM Preference and Transposase Activity

Figures 8A, 8B:
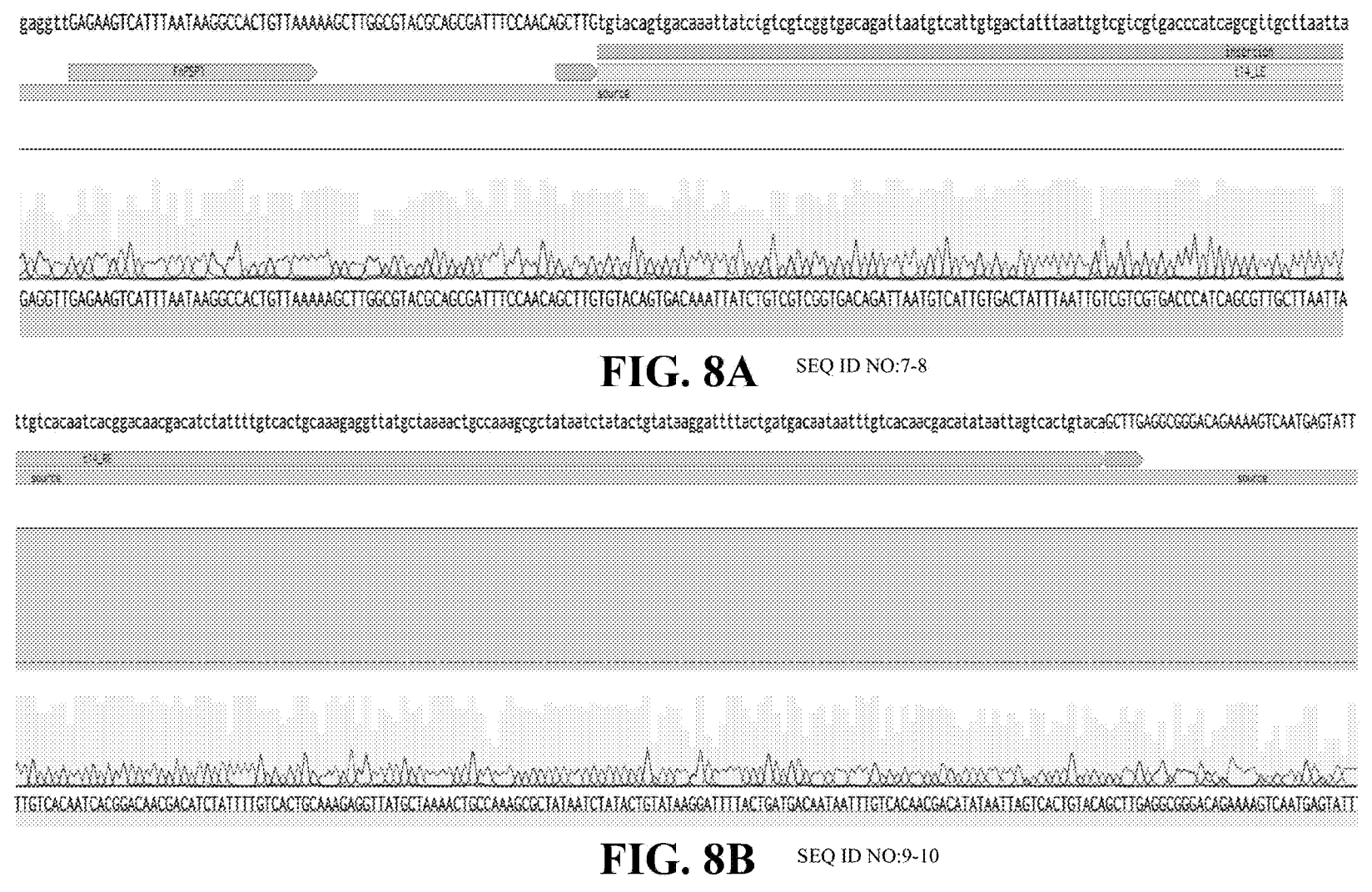

To further investigate the transposition mechanism, a system similar to that described in Example 7 was employed. In this case, the target was adjacent to a GTT PAM. Using Sanger sequencing confirmation of insertion into a GTT PAM target. The t14 donor was inserted downstream of a GCTTG target site at the left end junction and this site was confirmed to duplicated at the right end junction, consistent with the known activity of wild-type Tn7 transposase (FIG. 8).

Example 4—tracrRNAs

Figure 9:
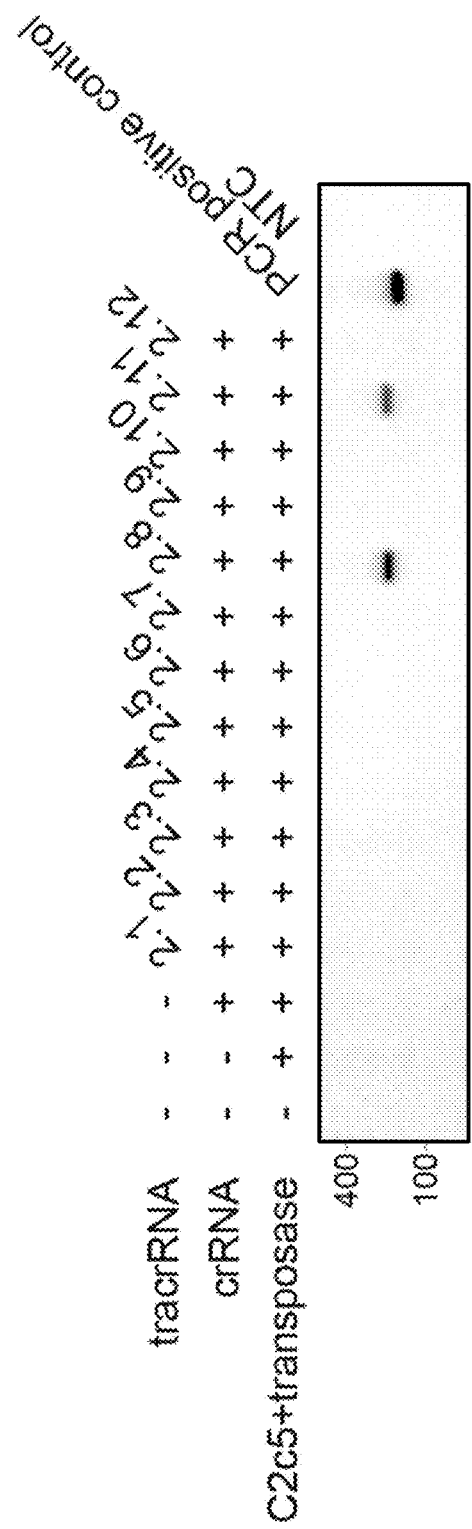
FIG. 9. RNA-guided transposition in vitro with purified components. tracrRNA 2.8 and 2.11 both mediate targeted insertions in the presence of TnsB, TnsC, TniQ, and C2c5.
Figure 10A:
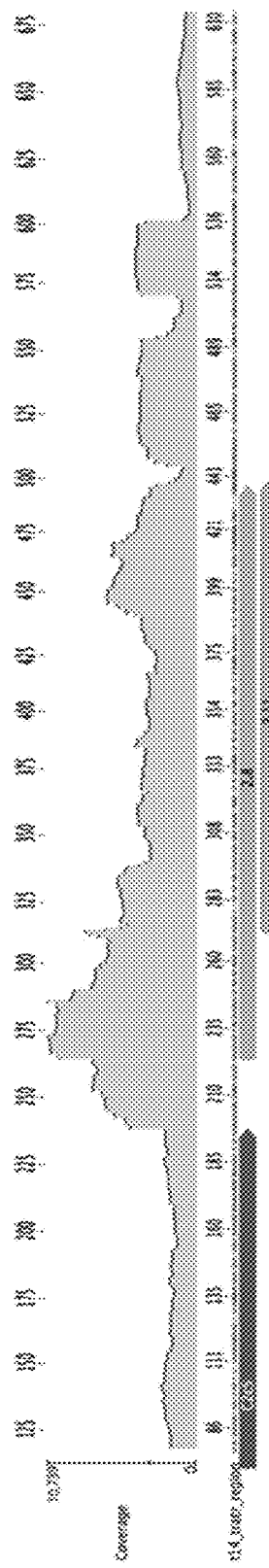
FIGS. 10A-10B. Predicted annealing of crRNA and tracrRNA.
Figure 10B:
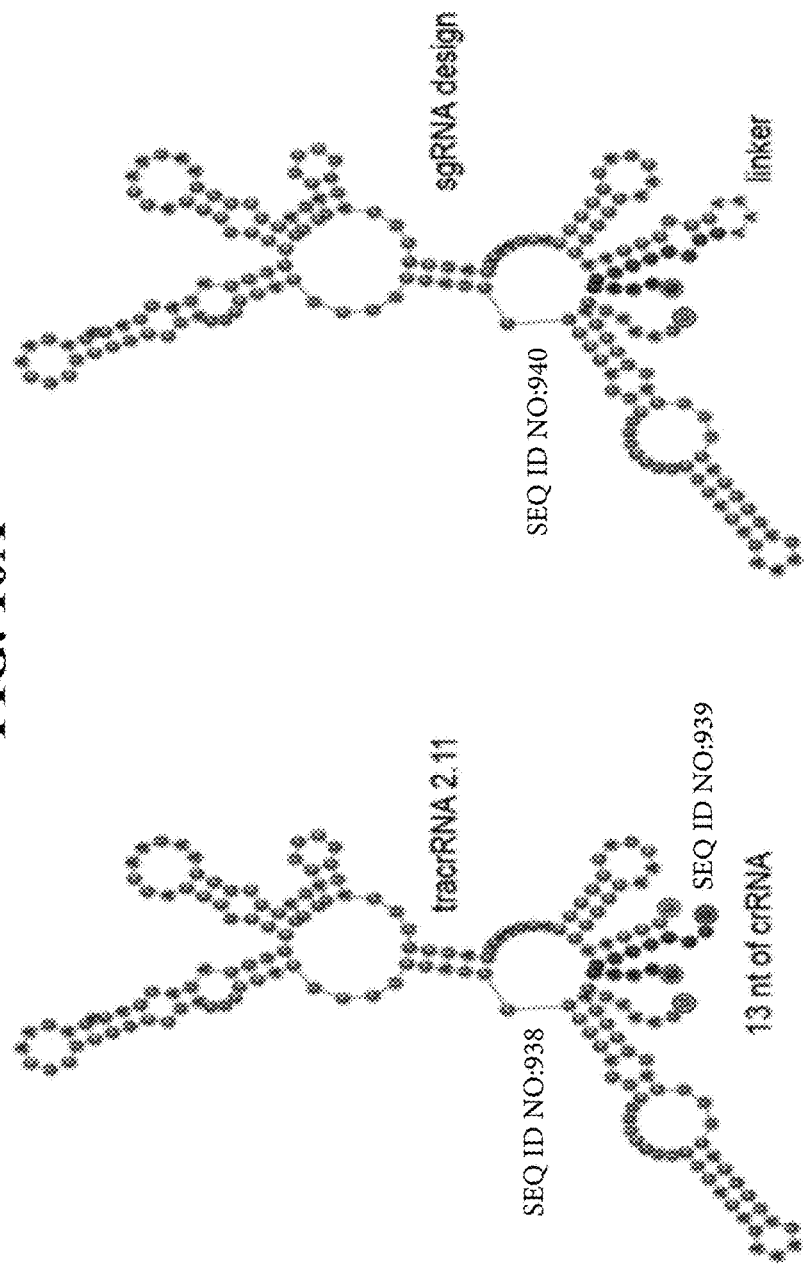

TracrRNA candidates initially identified on the basis of RNAseq signature were expanded by inclusion of additional sequences and tested for activity in an in vitro assay with crRNA, C2c5 and transposase (FIG. 9). tracrRNAs 2.8 and 2.11 were most active with the crRNA. Table 14 below shows the nucleotide sequences of tracrRNAs 2.8 and 2.11 and an sgRNA designed to incorporate the crRNA and tracrRNA 2.11. Models of tracrRNA 2.11 with crRNA and the sgRNA based on tracrRNA 2.11 are depicted in FIG. 10.

TABLE 15

| | |
|---|---|
| t14 tracrRNA 2.8 | AUAUUAAUAG CGCCGCAAUU CAUGCUGCUU GCAGCCUCUG AAUUUUGUUA AAUGAGGGUU AGUUUGACUG UAUAAAUACA GUCUUGCUUU CUGACCCUGG UAGCUGCUCA CCCUGAUGCU GCUGUCAAUA GACAGGAUAG GUGCGCUCCC AGCAAUAAGG GCGCGGAUGU ACUGCUGUAG UGGCUACUGA AUCACCCCCG AUCAAGGGGG AACCC (SEQ ID NO: 468) |
| t14 tracrRNA 2.11 | UUAAAUGAGG GUUAGUUUGA CUGUAUAAAU ACAGUCUUGC UUUCUGACCC UGGUAGCUGC UCACCCUGAU GCUGCUGUCA AUAGACAGGA UAGGUGCGCU CCCAGCAAUA AGGGCGCGGA UGUACUGCUG UAGUGGCUAC UGAAUCACCC CCGAUCAAGG GGGAACCCU (SEQ ID NO: 469) |
| sgRNA (2.11_tracr) | UUAAAUGAGG GUUAGUUUGA CUGUAUAAAU ACAGUCUUGC UUUCUGACCC UGGUAGCUGC UCACCCUGAU GCUGCUGUCA AUAGACAGGA UAGGUGCGCU CCCAGCAAUA AGGGCGCGGA UGUACUGCUG UAGUGGCUAC UGAAUCACCC CCGAUCAAGG GGGAACCCUC CAAAAGGUGG GUUGAAAG (SEQ ID NO: 470) |

Example 5—RNA Guided Insertion

Figure 11:
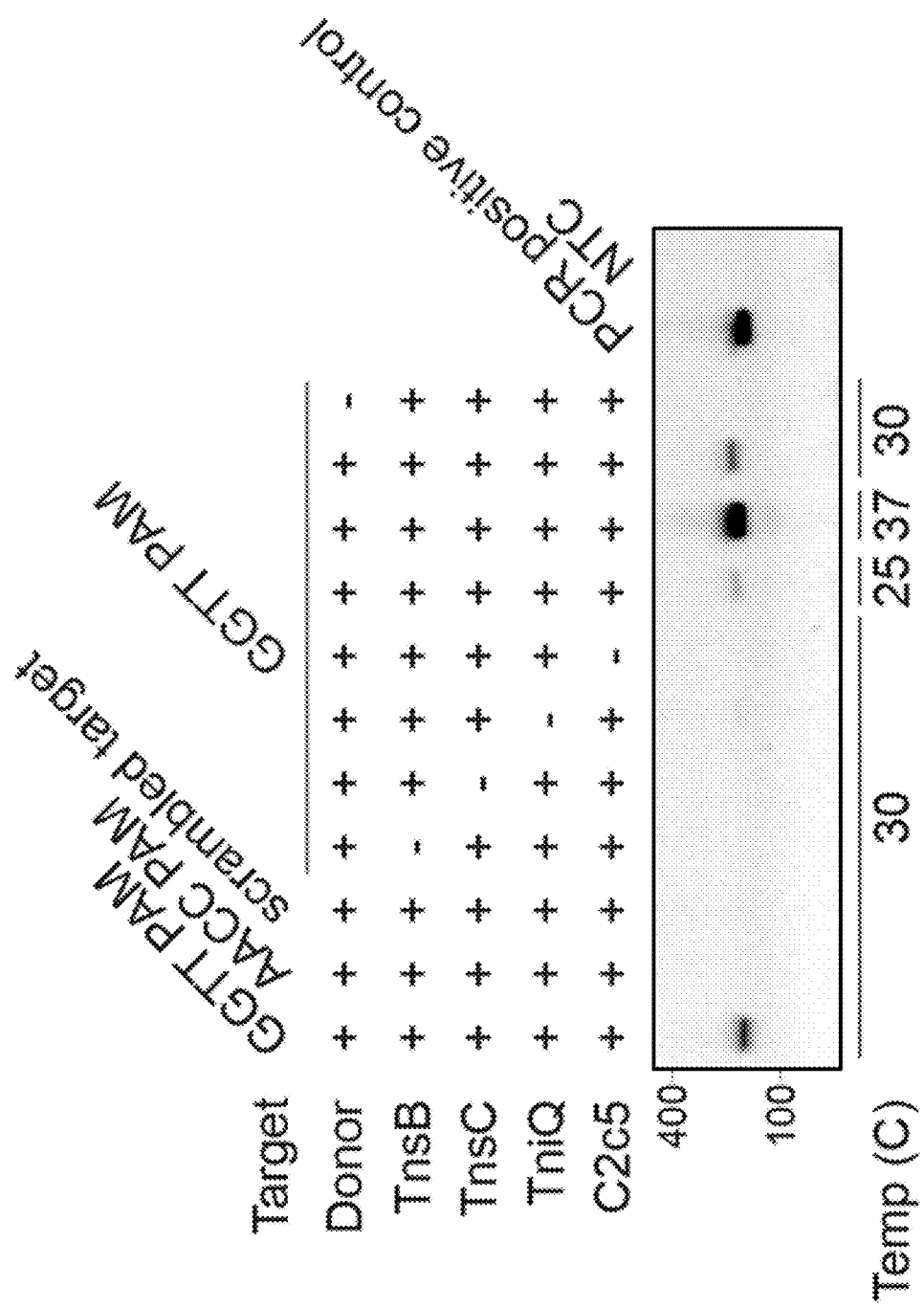
FIG. 11. In vitro conditions for RNA-guided insertions. Insertions are specific to the crRNA target sequence and are present with a 5' GGTT PAM but not an AACC PAM or a scrambled target. Insertions rely on all four protein components (TnsB, TnsC, TniQ, and C2c5) and removal of any factor abrogates activity. Insertions can occur at 25, 30, and 37 C with the highest activity observed at 37 C.

In vitro conditions for RNA-guided insertions. Insertions were specific to the crRNA target sequence and are present with a 5' GGTT PAM but not an AACC PAM or a scrambled target. Insertions rely on all four protein components (TnsB, TnsC, TniQ, and C2c5) and removal of any factor abrogates activity (FIG. 11). Insertions resulted at 25, 30, and 37° C. with the highest activity observed at 37° C. (FIG. 11).

Figure 12A:
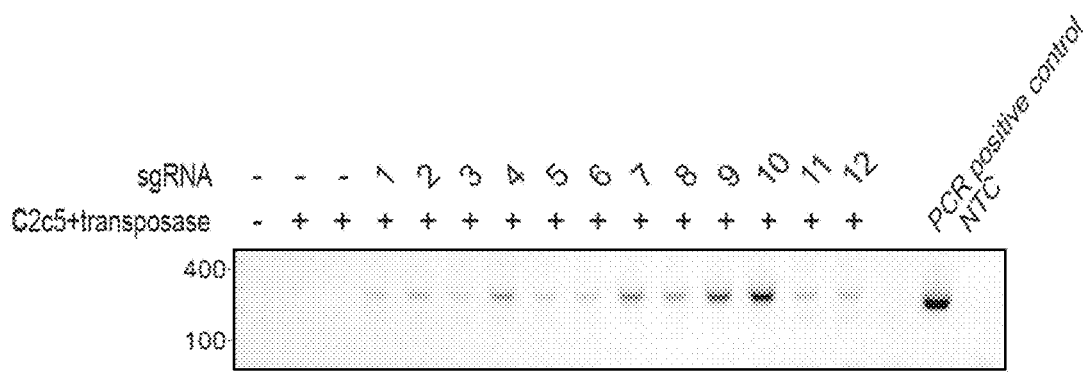
FIGS. 12A-12C. sgRNA variants.

Example 6—sgRNA Designs and Transposition Activity sgRNAs comprising tracers sequences having lengths from about 159 nucleotides (sgRNA_6) to about 218 nucleotides (sgRNA_9) joined at the 3' end by a linker to short crRNA sequences were designed and tested. Exemplary linkers comprise about 4 to 5 nucleotides, including 3-4 A nucleotides and one or two U nucleotides, designed to be the loop nucleotides of a stem-loop formed by base-pairing of the short crRNA with the 3' region of the tracr. An exemplary structure is shown for sgRNA_10 (FIG. 12C).

TABLE 16

Table 15-sgRNA designs

| | |
|---|---|
| sgRNA_1 (SEQ ID NO: 471) | UUAAAUGAGG GUUAGUUUGA CUGUAUAAAU ACAGUCUUGC UUUCUGACCC UGGUAGCUGC UCACCCUGAU GCUGCUGUCA AUAGACAGGA UAGGUGCGCU CCCAGCAAUA AGGGCGCGGA UGUACUGCUG UAGUGGCUAC UGAAUCACCC CCGAUCAAGG GGGAACCCUC CAAAAGGUGG GUUGAAAG |

TABLE 16-continued

Table 15-sgRNA designs

| | |
|---|---|
| sgRNA_2 (SEQ ID NO: 472) | GGUUAGUUUG ACUGUAUAAA UACAGUCUUG CUUUCUGACC CUGGUAGCUG CUCACCCUGA UGCUGCUGUC AAUAGACAGG AUAGGUGCGC UCCCAGCAAU AAGGGCGCGG AUGUACUGCU GUAGUGGCUA CUGAAUCACC CCCGAUCAAG GGGGAACCCU CCAAAAGGUG GGUUGAAAG |
| sgRNA_3 (SEQ ID NO: 473) | UUAAAUGAGG GUUAGUUUGA CUGUAUAAAU ACAGUCUUGC UUUCUGACCC UGGUAGCUGC UCACCCUGAU GCUGCUGUCA AUAGACAGGA UAGGUGCGCU CCCAGCAAUA AGGGCGCGGA UGUACUGCUG UAGUGGCUAC UGAAUCACCC CCGAUCAAGG GGGAACCCAC CAAAAGGUGG GUUGAAAG |
| sgRNA_4 (SEQ ID NO: 474) | GGUUAGUUUG ACUGUAUAAA UACAGUCUUG CUUUCUGACC CUGGUAGCUG CUCACCCUGA UGCUGCUGUC AAUAGACAGG AUAGGUGCGC UCCCAGCAAU AAGGGCGCGG AUGUACUGCU GUAGUGGCUA CUGAAUCACC CCCGAUCAAG GGGGAACCCA CCAAAAGGUG GGUUGAAAG |
| sgRNA_5 (SEQ ID NO: 475) | UUAAAUGAGG GUUAGUUUGA CUGUAUAAAU ACAGUCUUGC UUUCUGACCC UGGUAGCUGC UCACCCUGAU GCUGCUGUCA AUAGACAGGA UAGGUGCGCU CCCAGCAAUA AGGGCGCGGA UGUACUGCUG UAGUGGCUAC UGAAUCACCC CCGAUCAAGG GGGAACCCUA AAUGGGUUGA AAG |
| sgRNA_6 (SEQ ID NO: 476) | GGUUAGUUUG ACUGUAUAAA UACAGUCUUG CUUUCUGACC CUGGUAGCUG CUCACCCUGA UGCUGCUGUC AAUAGACAGG AUAGGUGCGC UCCCAGCAAU AAGGGCGCGG AUGUACUGCU GUAGUGGCUA CUGAAUCACC CCCGAUCAAG GGGAACCCU AAAUGGGUUG AAAG |
| sgRNA_7 (SEQ ID NO: 477) | AGCCTCTGAA TTTTGUUAAA UGAGGGUUAG UUUGACUGUA UAAAUACAGU CUUGCUUUCU GACCCUGGUA GCUGCUCACC CUGAUGCUGC UGUCAAUAGA CAGGAUAGGU GCGCUCCCAG CAAUAAGGGC GCGGAUGUAC UGCUGUAGUG GCUACUGAAU CACCCCCGAU CAAGGGGGAA CCCUCCAAAA GGUGGGUUGA AAG |
| sgRNA_8 (SEQ ID NO: 478) | AUUCAUGCUG CUUGCAGCCU CUGAAUUUUG UUAAAUGAGG GUUAGUUUGA CUGUAUAAAU ACAGUCUUGC UUUCUGACCC UGGUAGCUGC UCACCCUGAU GCUGCUGUCA AUAGACAGGA UAGGUGCGCU CCCAGCAAUA AGGGCGCGGA UGUACUGCUG UAGUGGCUAC UGAAUCACCC CCGAUCAAGG GGGAACCCUC CAAAAGGUGG GUUGAAAG |
| sgRNA_9 (SEQ ID NO: 479) | AUAUUAAUAG CGCCGCAAUU CAUGCUGCUU GCAGCCUCUG AAUUUUGUUA AAUGAGGGUU AGUUUGACUG UAUAAAUACA GUCUUGCUUU CUGACCCUGG UAGCUGCUCA CCCUGAUGCU GCUGUCAAUA GACAGGAUAG GUGCGCUCCC AGCAAUAAGG GCGCGGAUGU ACUGCUGUAG UGGCUACUGA AUCACCCCCG AUCAAGGGGG AACCCUCCAA AGGUGGGUU GAAAG |
| sgRNA_10 (SEQ ID NO: 480) | AUAUUAAUAG CGCCGCAAUU CAUGCUGCUU GCAGCCUCUG AAUUUUGUUA AAUGAGGGUU AGUUUGACUG UAUAAAUACA GUCUUGCUUU CUGACCCUGG UAGCUGCUCA CCCUGAUGCU GCUGUCAAUA GACAGGAUAG GUGCGCUCCC AGCAAUAAGG GCGCGGAUGU ACUGCUGUAG UGGCUACUGA AUCACCCCCG AUCAAGGGGG AACCCUAAAU GGGUUGAAAG |

TABLE 16-continued

Table 15-sgRNA designs

| | |
|---|---|
| sgRNA_11<br>(SEQ ID<br>NO: 481) | UGCAGCCUCU GAAUUUGUU AAAUGAGGGU<br>UAGUUUGACU GUAUAAAUAC AGUCUUGCUU<br>UCUGACCCUG GUAGCUGCUC ACCCUGAUGC<br>UGCUGUCAAU AGACAGGAUA GGUGCGCUCC<br>CAGCAAUAAG GGCGCGGAUG UACUGCUGUA<br>GUGGCUACUG AAUCACCCCC GAUCAAGGGG<br>GAACCCUCCA AAAGGUGGGU UGAAAG |
| sgRNA_12<br>(SEQ ID<br>NO: 482) | UGCAGCCUCU GAAUUUGUU AAAUGAGGGU<br>UAGUUUGACU GUAUAAAUAC AGUCUUGCUU<br>UCUGACCCUG GUAGCUGCUC ACCCUGAUGC<br>UGCUGUCAAU AGACAGGAUA GGUGCGCUCC<br>CAGCAAUAAG GGCGCGGAUG UACUGCUGUA<br>GUGGCUACUG AAUCACCCCC GAUCAAGGGG<br>GAACCCUAAA UGGGUUGAAA G |

Figure 12B:
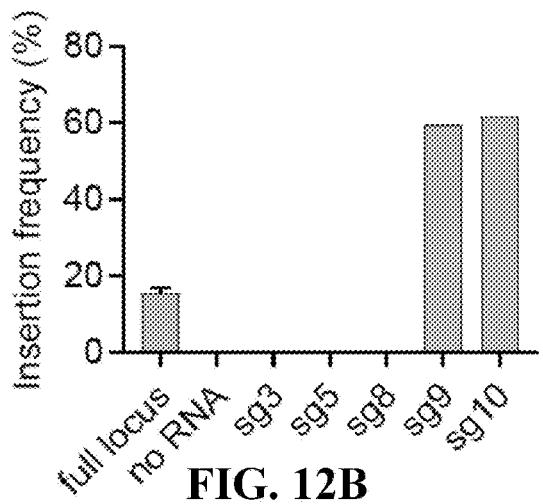
Figure 12C:
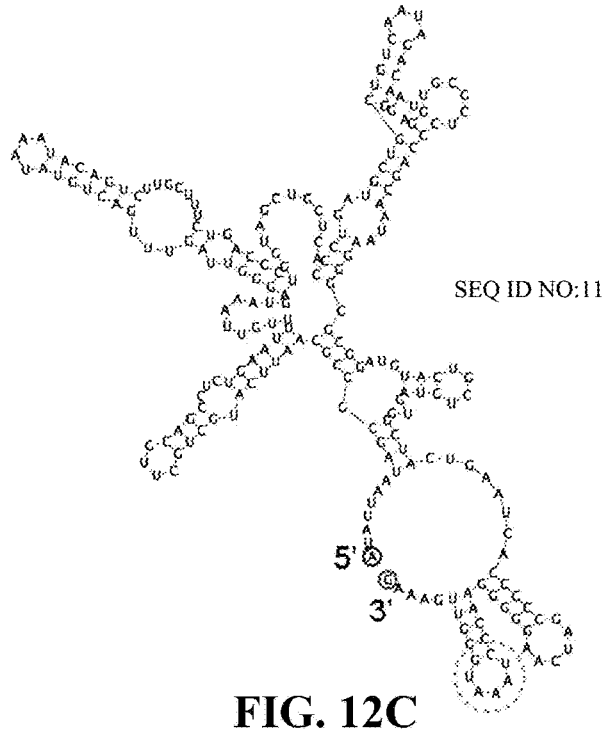

Activities of sgRNAs were evaluated in in vitro RNA-guided transpositions (FIG. 12A) and in transpositions in *E. coli* (FIG. 12B).

Example 7—RNA-Guided DNA Insertion with CRISPR-Cas Transposase

RNA-guided CRISPR-Cas nucleases have emerged as powerful tools to manipulate nucleic acids. However, targeted insertion of DNA has remained a major challenge as it relies on endogenous repair machinery of the host cell. Here Applicants characterized a CRISPR-associated transposase (CAST) and elucidated its molecular mechanism. The CAST from cyanobacteria *Scytonema hofmanni* consists of Tn7-like transposase subunits and the type V-J CRISPR effector (Cas12j) as well as associated CRISPR RNAs (crRNAs). ShCAST catalyzed crRNA-guided DNA transposition by unidirectionally inserting segments of foreign DNA 60-66 bp downstream of the crRNA recognition site in a Cas12j-dependent fashion. Applicants demonstrated that ShCAST mediated RNA-guided DNA insertion without relying on host factors, such as DNA double-strand break repair machinery, and could be fully reconstituted in vitro with purified protein and RNA components. ShCAST efficiently targeted and integrates DNA into unique sites in the *E. coli* genome with frequencies of up to 80% without positive selection. This work expanded the understanding of the functional diversity of systems and establishes a new paradigm for precision genome editing.

Prokaryotic Clustered Regularly Interspaced Short Palindromic Repeats (CRISPR) and CRISPR-associated proteins (Cas) systems provide adaptive immunity against foreign genetic elements via guide-RNA dependent DNA or RNA nuclease activity (1-3). CRISPR effectors, such as Cas9 and Cas12, have been harnessed for genome editing (4-8) and create targeted DNA double-strand breaks in the genome, which are then repaired using endogenous DNA damage repair pathways. An outcome of repair following Cas9 cleavage is the generation of small insertions and deletions arising from non-homologous end joining, typically leading to gene disruption. Although it is possible to achieve precise integration of new DNA following Cas9 cleavage either through homologous recombination (9) or non-homologous end-joining (10, 11), these processes may be inefficient and vary greatly depending on cell type. Homologous recombination repair may be also tied to cell division making it unsuitable for the vast number of post-mitotic cells that organisms contain. In addition, base editing may also be restricted to nucleotide substitutions, and thus efficient and targeted integration of DNA into the genome remains a major challenge.

To overcome these limitations, Applicants sought to leverage self-sufficient DNA insertion mechanisms, such as transposons. Applicants explored bioengineering approaches of CRISPR-Cas effectors to facilitate DNA transposition (FIG. 19). Cas9 binding to DNA generated an R-loop structure and exposed a substrate for enzymes that acted on single-stranded DNA. By tethering Cas9 to the single-stranded DNA transposase TnpA from *Helicobacter pylori* IS608 (16, 17) Applicants observed targeted DNA insertions in vitro that were dependent on TnpA transposase activity, Cas9 sgRNA, and the presence of a TnpA insertion site within the displaced DNA strand.

To date, no functional data on transposon-encoded systems have been reported. Here, Applicants showed that Tn7-like transposons can be directed to target sites via crRNA-guided targeting and elucidated the molecular mechanism of crRNA-guided Tn7 transposition. Applicants further demonstrated that Tn7 transposition could be reprogrammed to insert DNA into the endogenous genome of *E. coli*, highlighting the potential of using RNA-guided Tn7-like transposons as a new approach for genome editing.

Characterization of a Transposon Associated with a Type-V CRISPR System

Figure 13A:
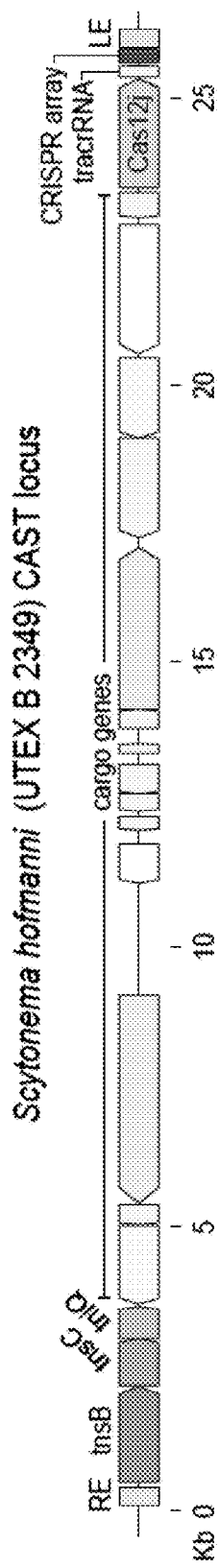
FIGS. 13A-13C. CRISPR-associated transposase (CAST) systems.
Figure 13B:
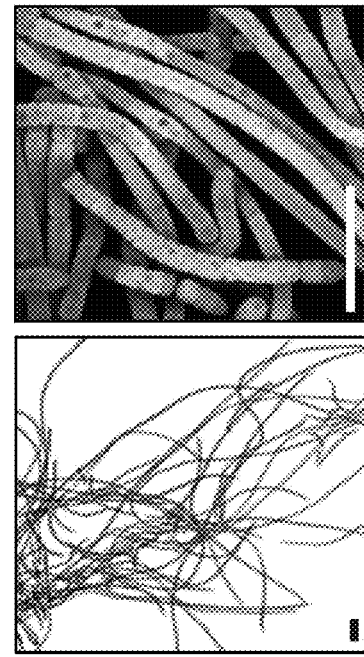
Figure 13C:
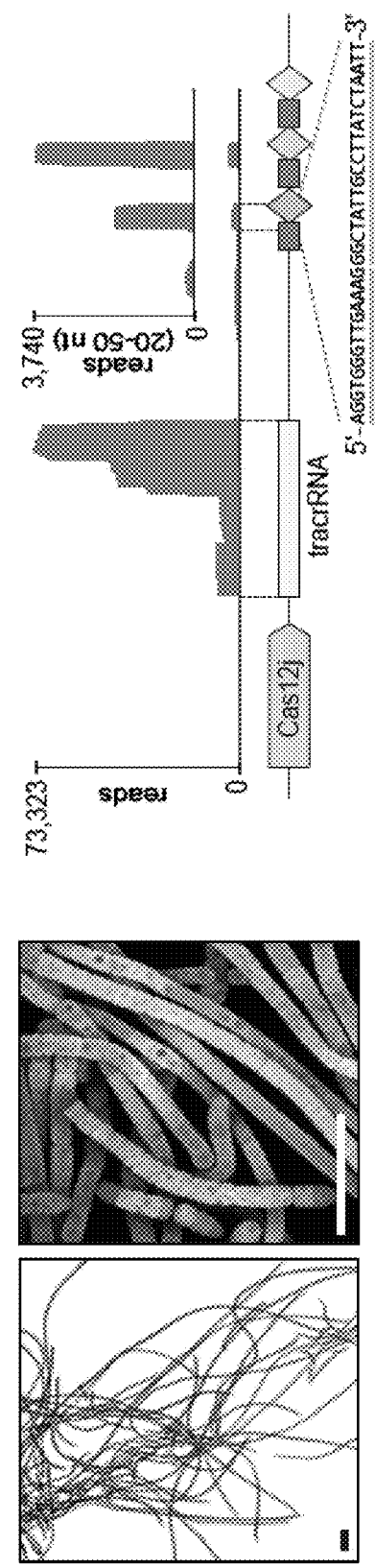

Among the transposon-encoded CRISPR-Cas variants, those of subtype V-J are the most attractive experimental systems because they contain a single protein CRISPR-Cas effector (18, 20, 26). For experimental characterization, Applicant selected two Tn7-like transposons encoding subtype V-J CRISPR-Cas systems (hereafter, CAST, CRISPR-associated Transposase) from cyanobacteria. The selected CAST loci were 20-25 kb in length and contained Tn7-like transposase genes at one end of the transposon with a CRISPR array and Cas12j on the other end, flanking internal cargo genes (FIGS. 13A, 20A, 20B). Applicants first cultured the native organisms *Scytonema hofmanni* (UTEX B 2349, FIG. 13B) and *Anabaena cylindrica* (PCC 7122) and performed small RNA-sequencing to determine if the CRISPR-Cas systems were expressed and active. For both loci Applicants identified a long putative tracrRNA that mapped to the region between Cas12j and the CRISPR array, and in the case of *S. hofmanni* (ShCAST) Applicants detected crRNAs 28-34 nt long (FIGS. 13C, 20C). The detected crRNAs consisted of 11-14 nt of direct repeat (DR) sequence with 17-20 nt of spacer.

Figure 15A:
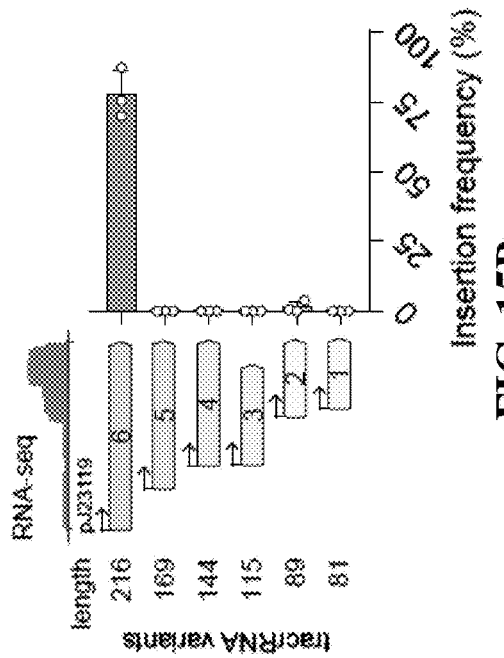
FIGS. 15A-15D. Genetic requirements for RNA-guided insertions.
Figure 15B:
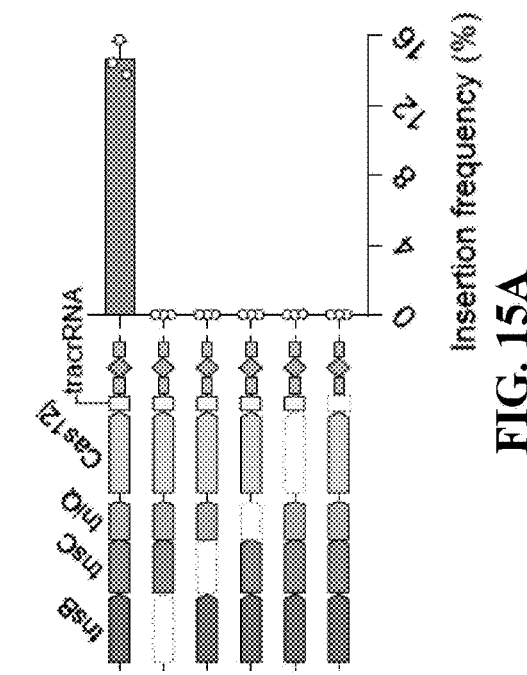

To investigate whether ShCAST and AcCAST function as RNA-guided transposases, Applicants cloned the four CAST genes (tnsB, tnsC, tniQ, and Cas12j) into a helper plasmid (pHelper) along with expression cassettes for the tracrRNA and a crRNA targeting a synthetic protospacer (PSP1). Applicants predicted the ends of the Tn7-like transposons by searching for TGTACA-like terminal repeats surrounded by a duplicated insertion site (18) and constructed donor plasmids (pDonor) containing the kanamycin resistance gene flanked by the transposon left end (LE) and right end (RE). Given that CRISPR-Cas effectors needed a protospacer adjacent motif (PAM) to recognize target DNA (27), Applicants generated a target plasmid (pTarget) library containing the PSP1 sequence flanked by a 6N motif upstream of the protospacer. Applicants co-electroporated pHelper, pDonor, and pTarget into *E. coli* and extracted plasmid DNA after 16 h (FIG. 14A). Applicants detected insertions into the target plasmid by PCR for both ShCAST and AcCAST and deep sequencing of the product confirmed the insertion of the LE into pTarget. Analysis of PAM sequences in pInsert plasmids revealed a preference for GTN PAMs for both ShCAST and AcCAST systems, suggesting that these events result from Cas12j targeting (FIGS. 14A, 15A, 15B). Applicants next examined the position of the donor in pInsert products relative to the protospacer. Insertion were detected within a small window 60-66 bp downstream from the PAM for ShCAST and 49-56 bp from the PAM for AcCAST (FIG. 14C). No insertions were detected in the opposite orientation for either system, indicating that CAST functions unidirectionally. Although DNA insertions could potentially arise from genetic recombination in E. coli, the discovery of an associated PAM sequence and the constrained position of insertions argued against this possibility.

Figure 21A:
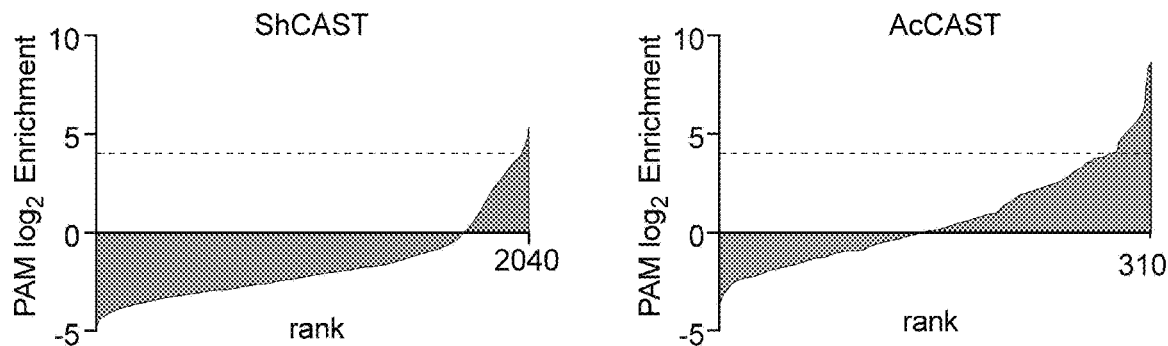
FIGS. 21A-21C. Targeting requirements for RNA-guided insertions.
Figure 21B:
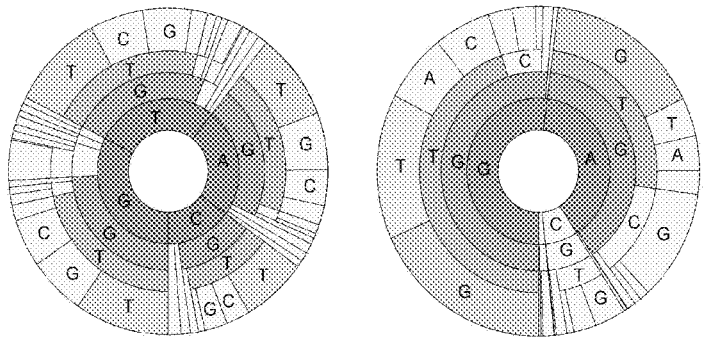
Figure 21C:
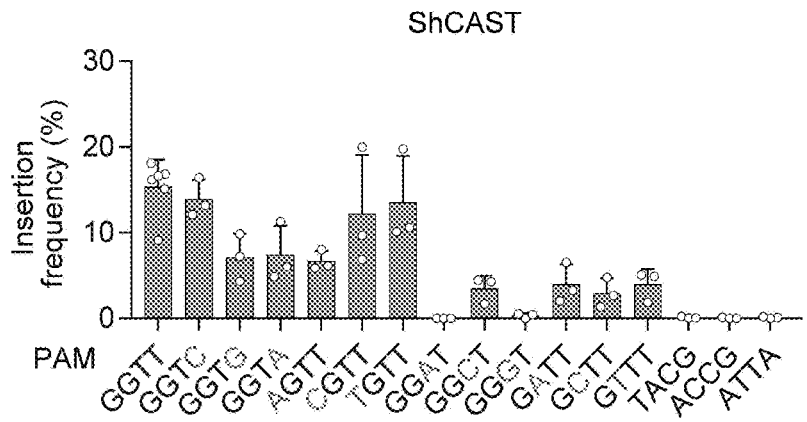
Figure 22:
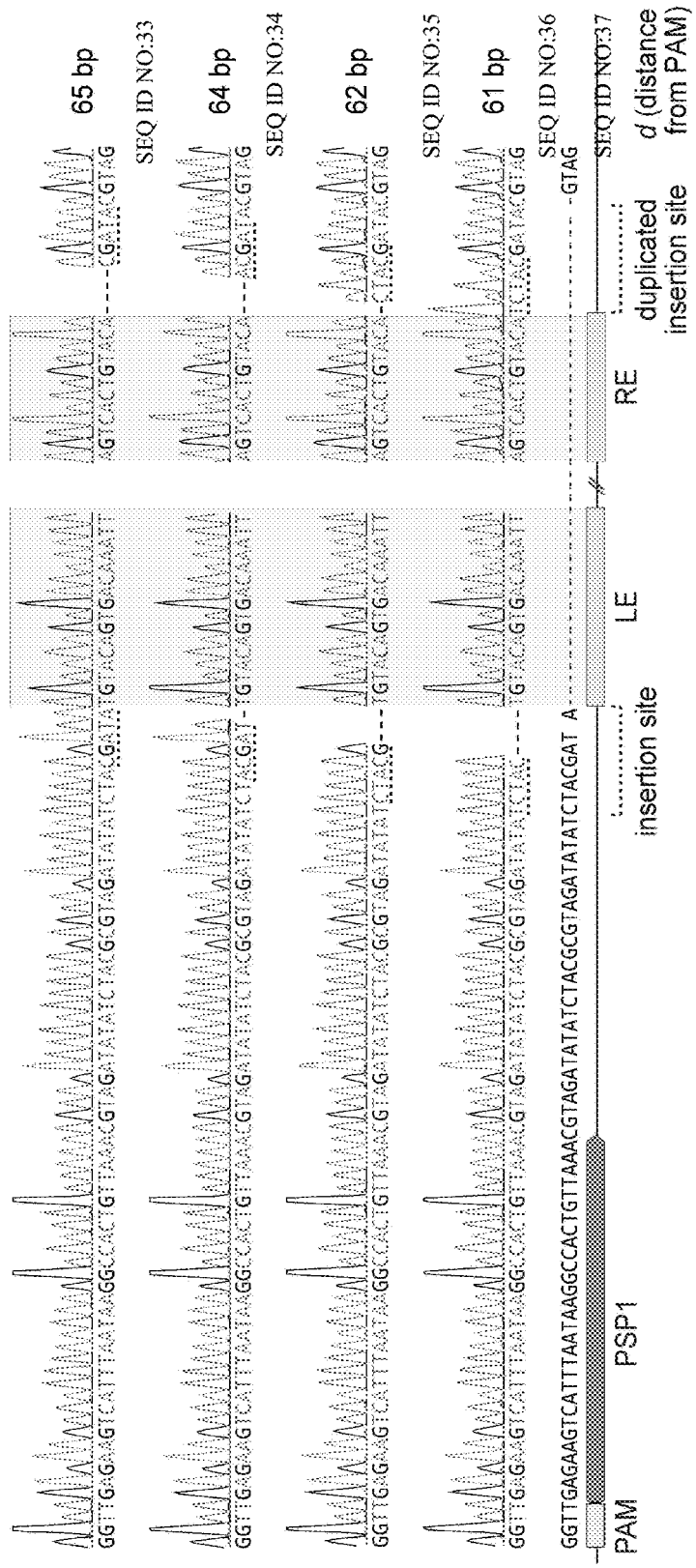
FIG. 22. Sanger sequencing of targeted insertion products in *E. coli*. Plasmid DNA from *E. coli* transformed with pHelper, pDonor, and pTargetGGTT was re-transformed into *E. coli* and Sanger sequenced verified. The duplicated insertion site is underlined in each trace (SEQ ID NO:33-37).

To validate these findings, Applicants transformed E. coli with ShCAST pHelper and pDonor plasmids along with target plasmids containing a GGTT PAM, an AACC PAM, and a scrambled non-target sequence. Applicants assessed insertion events by quantitative droplet digital PCR (ddPCR), which revealed insertions of the donor only in the presence of pHelper and a pDonor containing the GGTT PAM and crRNA-matching protospacer sequence (FIG. 14D). Additional experiments with 16 PAM sequences confirmed a preference for NGTN motifs (FIG. 21C). As further validation, Applicants recovered pInsert products and performed Sanger sequencing of both LE and RE junctions. All sequenced insertions were located 60-66 bp from the PAM and contained a 5-bp duplicated insertion motif flanking the inserted DNA (FIG. 22), consistent with the staggered DNA breaks generated by Tn7 (28). As Tn7 inserts into a CCCGC motif downstream of its attachment site, Applicants hypothesized that the sequence within the insertion window might also be important for CAST function. Applicants generated a second target library with an 8N motif located 55 bp from the PAM and again co-transformed the library into E. coli with ShCAST pHelper and pDonor followed by deep sequencing (FIG. 23A). Applicants observed only a minor sequence preference upstream of the LE in pInsert, with a slight T/A preference 3 bases upstream of the insertion site (FIGS. 23B-23D). ShCAST could therefore target a wide range of DNA sequences with minimal targeting rules. Together these results indicate that AcCAST and ShCAST catalyzed DNA insertion in a heterologous host and that these insertions are dependent on a targeting protospacer and a distinct PAM sequence.

Genetic Requirements for RNA-Guided Insertions

Figure 15C:
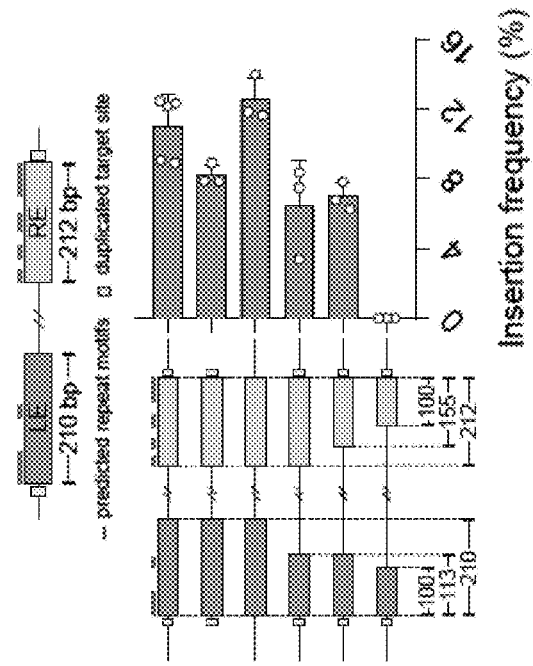
Figure 15D:
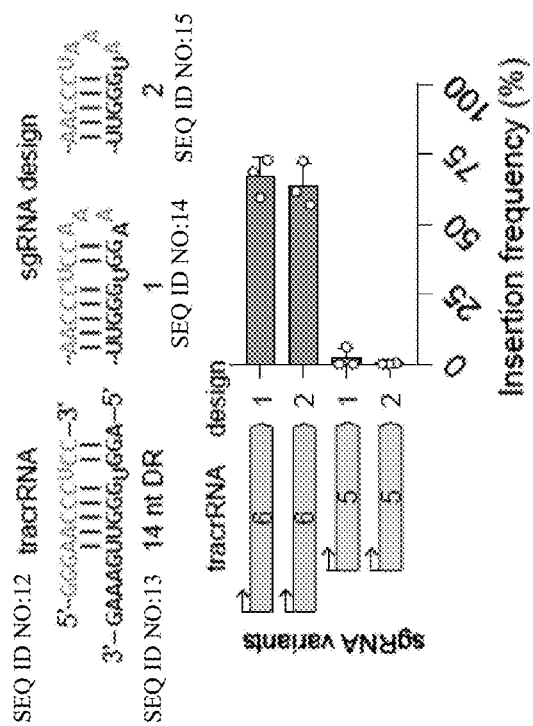
Figures 24A, 24B:
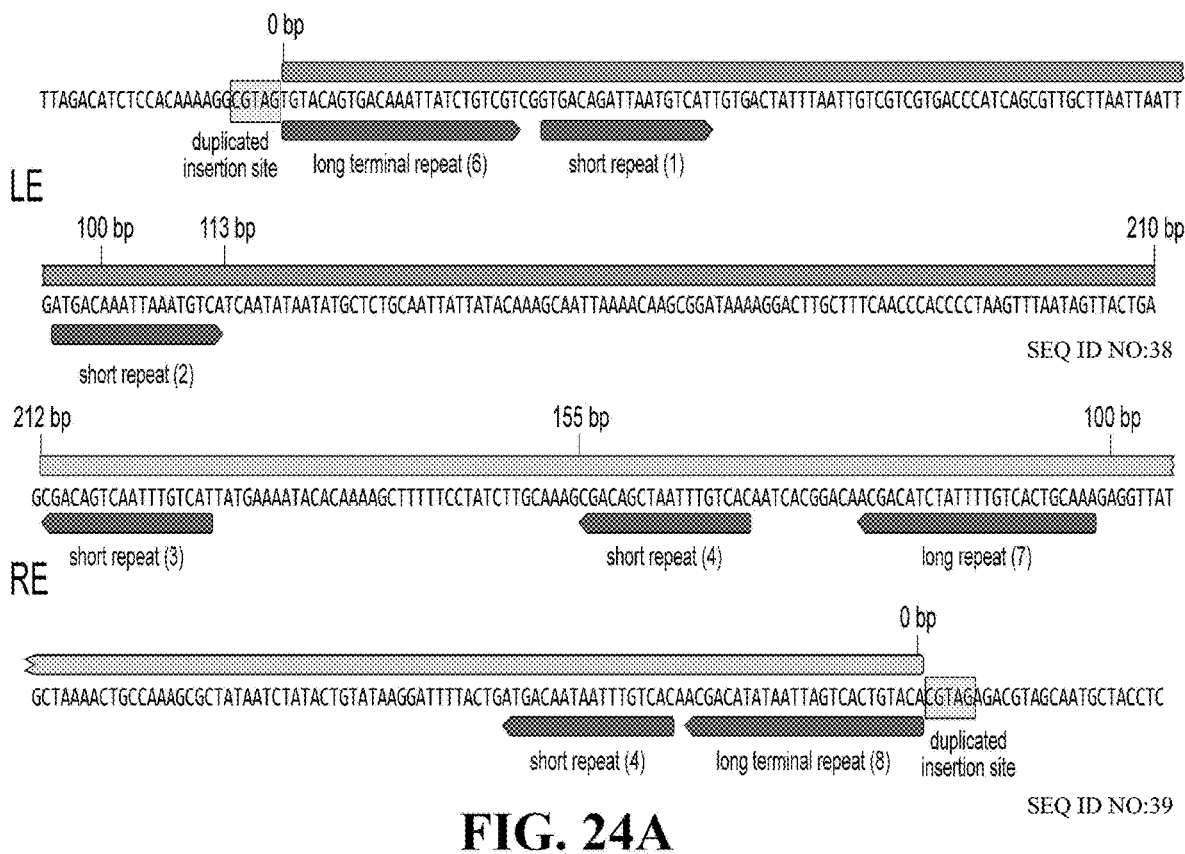
FIGS. 24A-24B. ShCAST transposon ends sequence analysis.

Applicants next sought to determine the genetic requirements for ShCAST insertions in E. coli and, to that end, constructed a series of pHelper plasmids with deletions of each element. Insertions into pTarget required all four CAST proteins (TnsB, TnsC, TniQ, and Cas12j) as well as the tracrRNA region (FIG. 15A). To better understand the tracrRNA sequence, Applicants complemented pHelperΔtracrRNA with tracrRNA variants driven by the pJ23119 promoter. Expression of the 216-nt tracrRNA variant 6 was sufficient to restore DNA insertions into pTarget whereas all other truncations failed to exhibit activity in vivo (FIG. 15B). The 3' end of the tracrRNA was predicted to hybridize with a crRNA containing 14 nt of the DR sequence and, to simplify the system, Applicants designed single guide RNAs (sgRNA) testing two linkers between the tracrRNA and crRNA sequences. Both designs supported insertion activity in the context of the tracrRNA variant 6 (FIG. 15C). Applicants observed that expression of tracrRNA or sgRNA with the pJ23119 promoter resulted in a 5-fold increase in the insertion activity compared to the natural locus, suggesting that RNA levels were rate-limiting during heterologous expression. Finally, Applicants investigated the requirement of the LE and RE transposon ends sequences contained in pDonor for DNA insertion. Removal of all flanking genomic sequence or the 5 bp duplicated target sites had little effect on insertion frequency, and ShCAST tolerated truncations of LE and RE to 113 bp and 155 bp, respectively (FIG. 15D). Removal of additional donor sequence completely abolished transposase activity, consistent with the loss of predicted Tn7 TnsB-like binding motifs (FIG. 24).

In Vitro Reconstitution of ShCAST

Figure 16A:
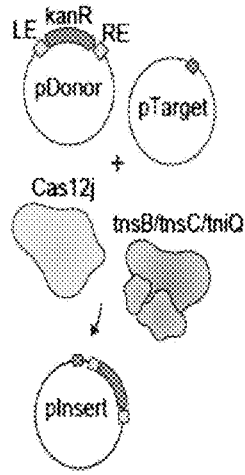
FIGS. 16A-16F. In vitro reconstitution of an RNA-guided transposase.
Figure 16B:
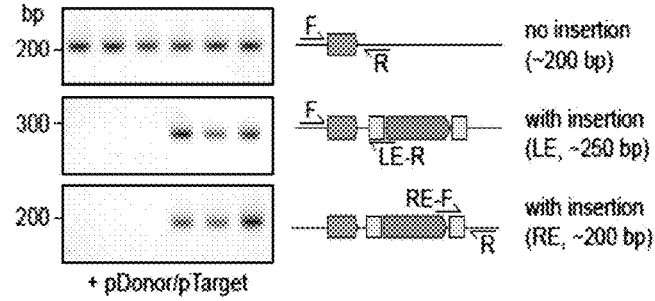
Figure 16C:
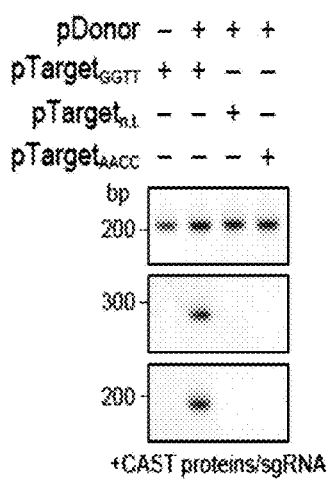
Figure 16D:
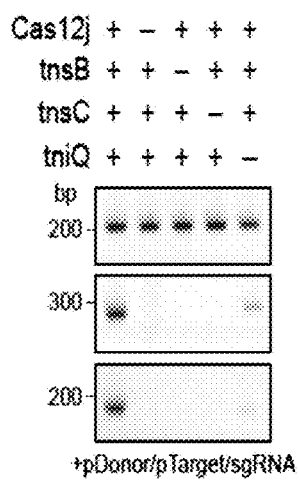

Although the data strongly suggested that ShCAST mediates RNA-guided DNA insertion, to exclude the requirement of additional host factors, Applicants next sought to reconstitute the reaction in vitro. Applicants purified all four ShCAST proteins (FIG. 25A) and performed in vitro reactions using pDonor, pTarget, and purified RNA (FIG. 16A). Addition of all four protein components, crRNA, and tracrRNA resulted in DNA insertions detected by both LE and RE junction PCRs as did reactions containing the four protein components and sgRNA (FIG. 16B). The truncated tracrRNA variant 5 was also able to support DNA-insertion in vitro, in contrast with the activity observed in E. coli. ShCAST-catalyzed transposition in vitro occurred between 37-50° C. and depended on ATP and Mg2+(FIGS. 25B, 25C). To confirm that in vitro insertions were in fact targeted, Applicants performed reactions with target plasmids containing a GGTT PAM, an AACC PAM, and a scrambled non-target sequence, and could only detect DNA insertions into the GGTT PAM substrate with the target sequence (FIG. 16C). In vitro DNA transposition depended on all four CAST proteins, although Applicants identified weak but detectable insertions in the absence of tniQ (FIG. 16C). Given that tniQ is required for ShCAST activity in E. coli, this result indicates that the in vitro conditions might compensate for the lack of tniQ possibly through significantly higher concentrations of the protein components relative to the concentration inside of cells.

Figure 16E:
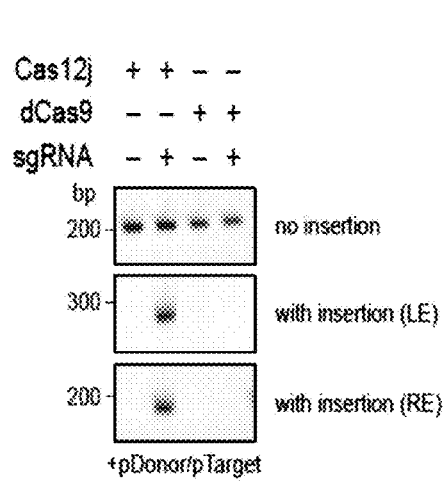
Figure 16F:
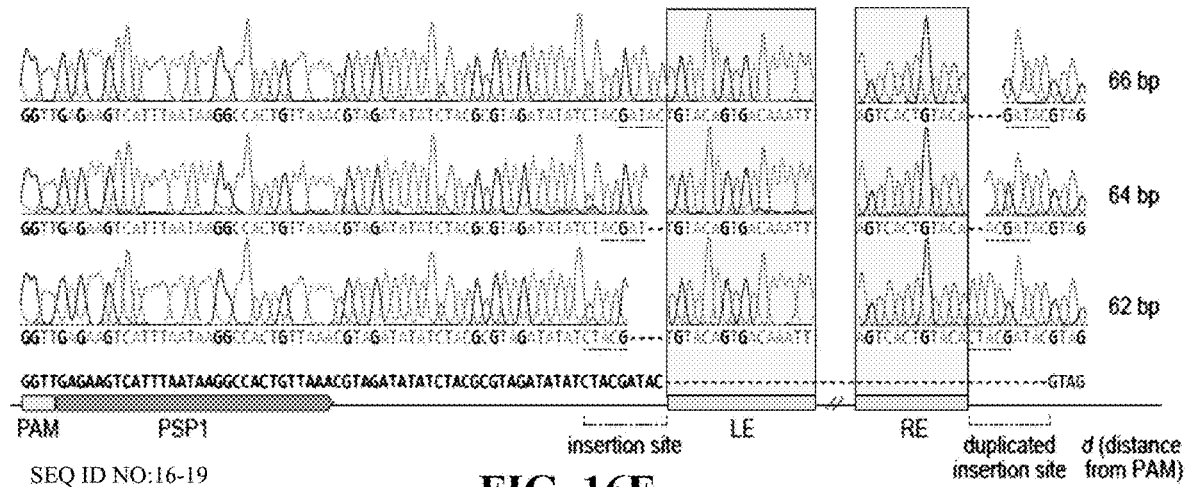

Consistent with the predicted lack of nuclease activity of Cas12j, Applicants were unable to detect DNA cleavage in the presence of Cas12j and sgRNA across a range of buffer conditions (FIG. 25D). Together these results support the hypothesis that Cas12j played a targeting role in RNA-guided DNA transposition and did not contribute to DNA strand cleavage. To determine whether other CRISPR-Cas effectors could also stimulate DNA transposition, Applicants performed reactions with tnsB, tnsC, and tniQ, along with dCas9 and a sgRNA targeting the same GGTT PAM substrate. Applicants were unable to detect any insertions following dCas9 incubation (FIG. 16E), indicating that the role of Cas12j was not limited to general DNA binding and that DNA transposition by CAST did not simply occur at R-loop structures. As final validation, Applicants transformed in vitro reaction products into E. coli for amplification and performed Sanger using donor-specific primers to determine the LE and RE junctions. All sequenced donors were located in pTarget 60-66 bp from the PAM and containing duplicated 5-bp insertion sites, demonstrating complete reconstitution of ShCAST with purified components.

ShCAST Mediates Efficient and Precise Genome Insertions in E. coli

Figure 17A:
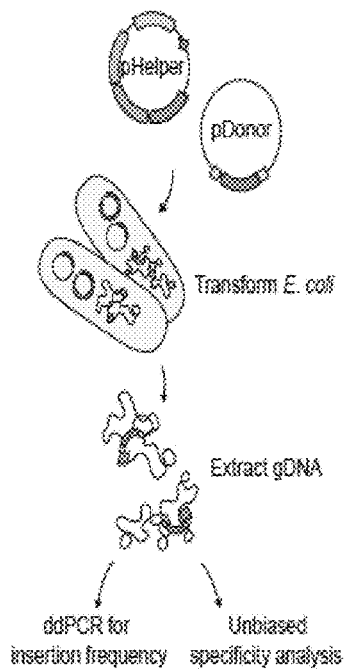
FIGS. 17A-17E. ShCAST mediates genome insertions in *E. coli*.
Figure 17B:
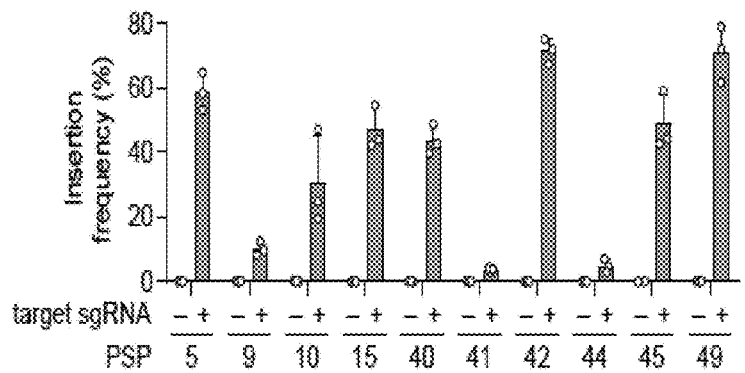
Figure 17C:
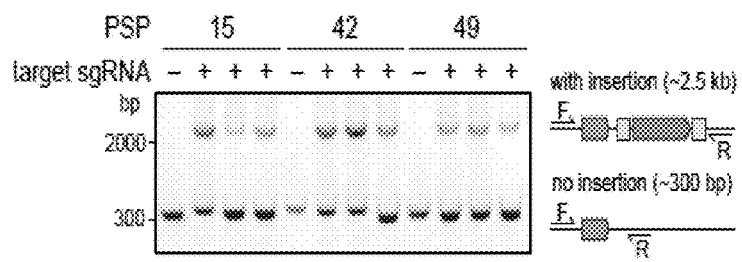
Figure 26A:
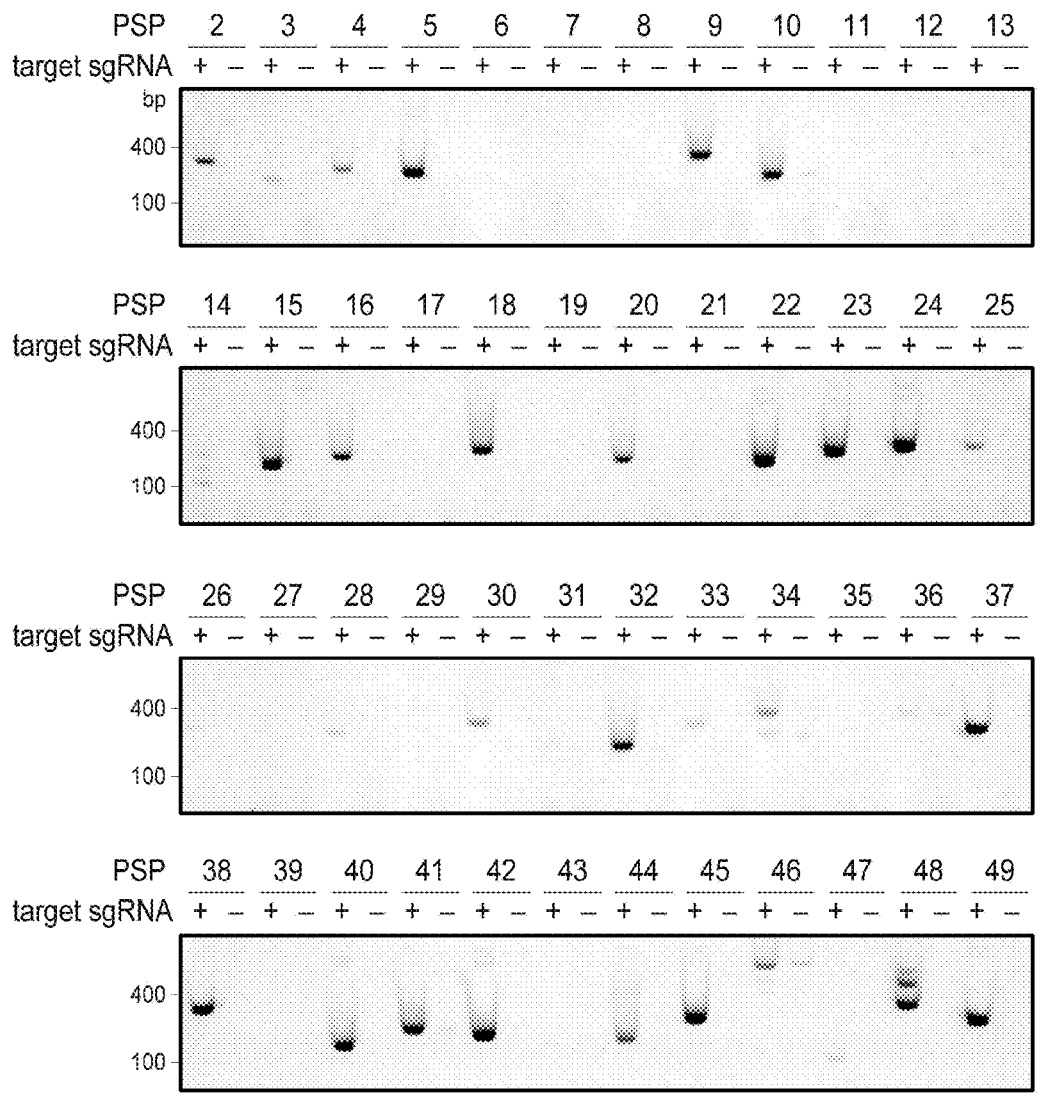
FIGS. 26A-26B. ShCAST mediates genome insertions in E. coli.
Figure 26B:
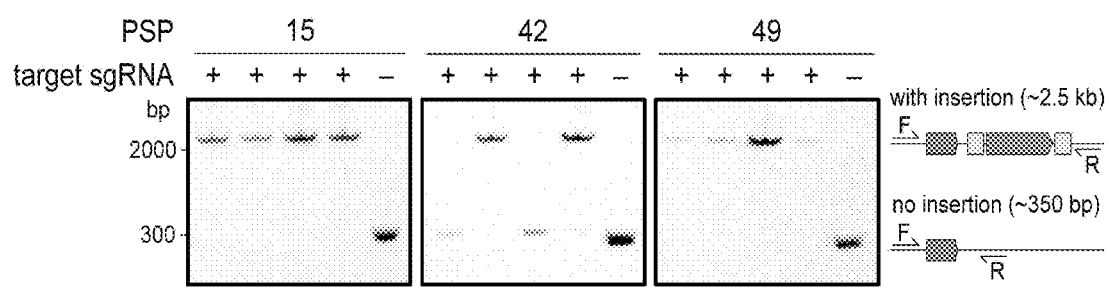

To test whether ShCAST could be reprogrammed as a DNA insertion tool, Applicants selected 48 targets in the E. coli genome containing NGTN PAMs and co-transformed pDonor and pHelper plasmids expressing targeting sgRNAs (FIG. 17A). Applicants detected insertions by PCR at 29 out of the 48 sites (60.4%) and selected 10 sites for additional validation (FIG. 26A). Applicants performed ddPCR to quantitate insertion frequency after 16 h and measured rates up to 80% at PSP42 and PSP49 (FIG. 17B). This high efficiency of insertion was surprising given that insertion events were not selected for by antibiotic resistance, so Applicants performed PCR of target sites to confirm. Strikingly, Applicants robustly detected the 2.5 kb insertion product in the transformed population (FIG. 17C) confirming the high efficiency of DNA transposition catalyzed by ShCAST. Re-streaking transformed E. coli yielded pure single colonies, the majority of which contained the targeted insertion (FIG. 26B).

Figure 17D:
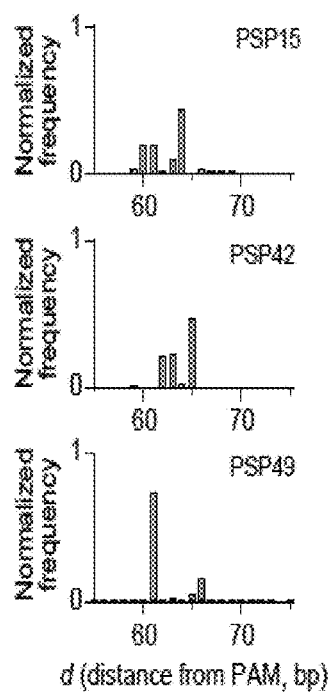
Figure 17E:
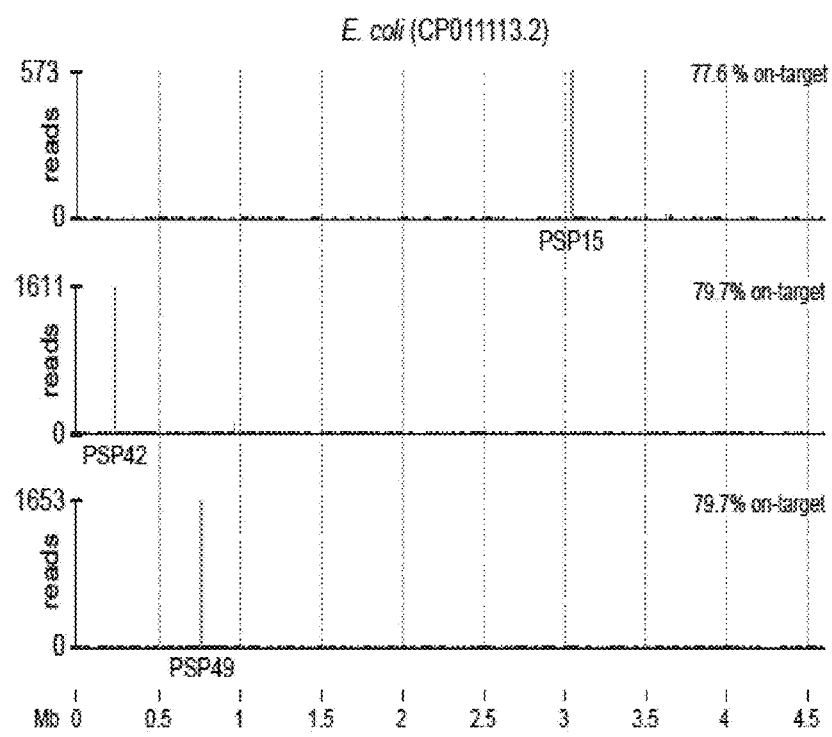
Figure 27:
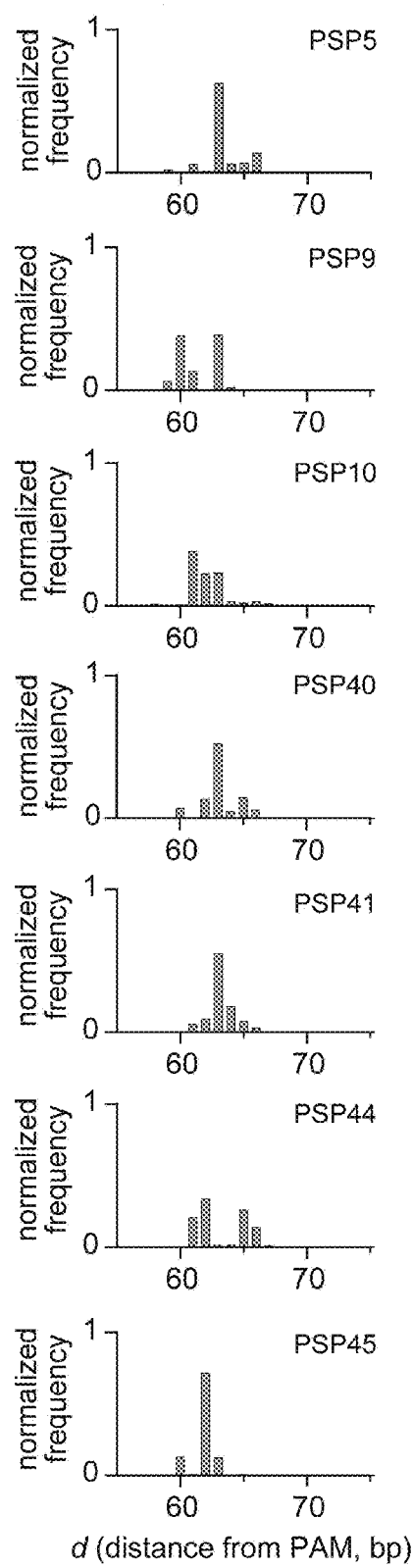
FIG. 27. Sequence analysis of E. coli genome insertions. Targeted amplification of genomic insertions and deep sequencing to identify position of insertions.

Applicants analyzed the position of genome insertions by performing targeted deep sequencing of the LE and RE junctions and observed insertions within the 60-66 bp window at all 10 sites (FIGS. 17D, 27), demonstrating the on-target activity of ShCAST. Applicants next assayed the specificity of RNA-guided DNA transposition. Applicants performed unbiased sequencing of donor insertions following Tn5 tagmentation of gDNA. Applicants observed one prominent insertion site in each sample, which mapped to the target site, and contained more than 75% of the total insertion reads (FIG. 17E). Together, these results indicated that ShCAST robustly and precisely inserts DNA with minimal off-target insertions.

DISCUSSION

Figure 18:
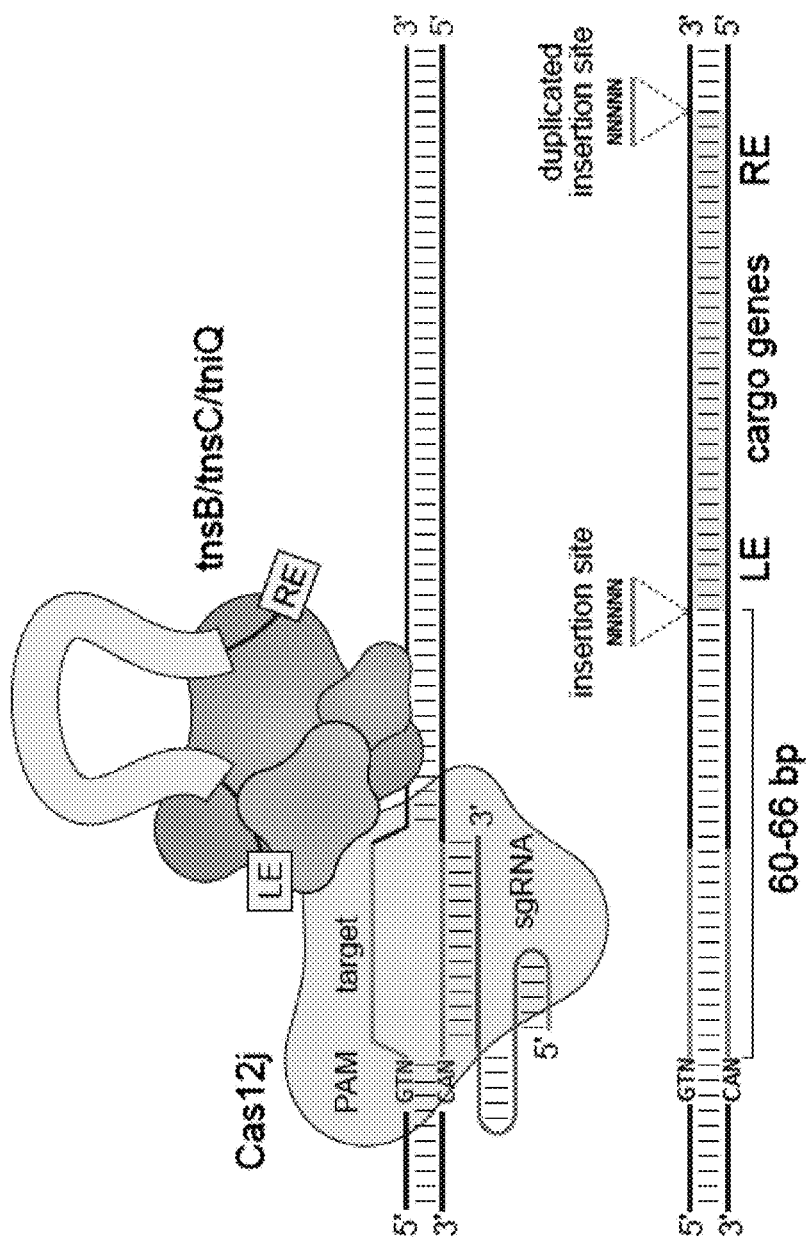
FIG. 18. Model for RNA-guided DNA transposition. The ShCAST complex that consists of Cas12j, TnsB, TnsC, and TniQ mediates insertion of DNA 60-66 bp downstream of the PAM. Transposon LE and RE sequences along with any additional cargo genes are inserted into DNA resulting in the duplication of 5 bp insertion sites.

Here Applicants characterize a CRISPR-Cas system associated with a Tn7-like transposon and provide evidence of RNA-guided DNA transposition in E. coli and in vitro. ShCAST mediates efficient and precise unidirectional insertions in a narrow window downstream of the target (FIG. 18). Applicants demonstrate the insertion of 2.2 kb of donor DNA, but the natural size of CAST loci suggests that up to 20 kb of cargo could be inserted. Although ShCAST and AcCAST exhibit similar PAM preference, one notable difference is that their respective positions of insertion relative to the PAM, differ by around 10-11 bp, which corresponds to roughly one turn of DNA.

Figure 28:
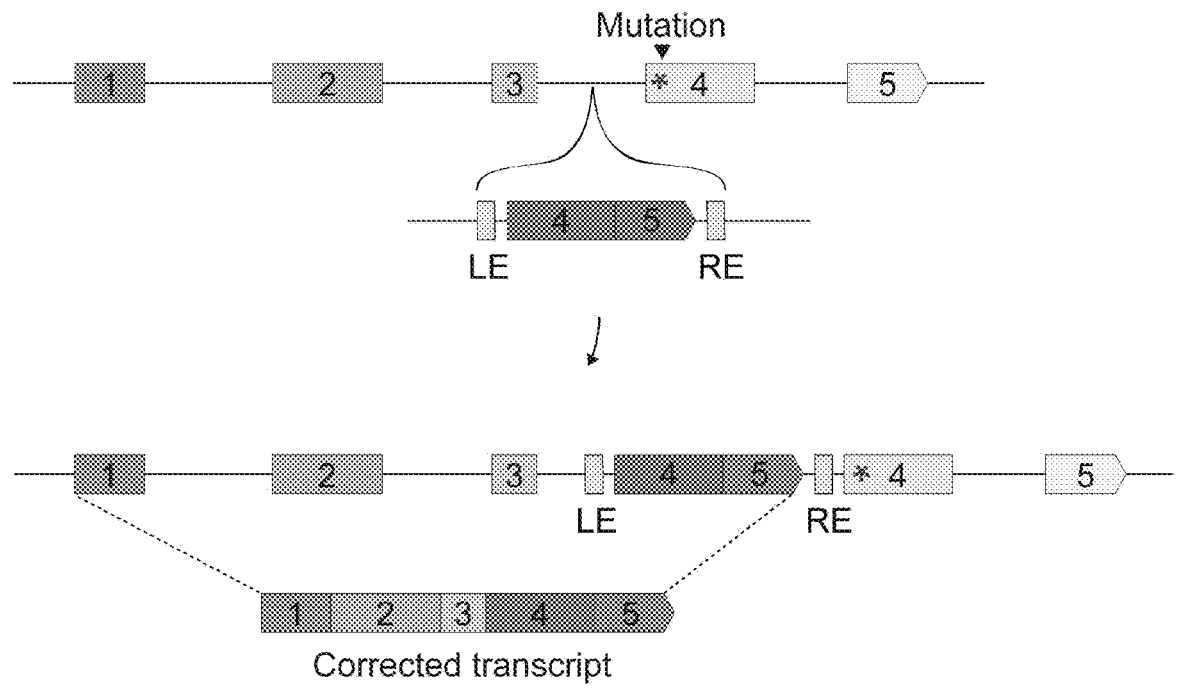
FIG. 28. Potential strategy for CAST-mediated gene correction. Replacement of a mutation-containing exon by targeted DNA insertion.

One generalizable strategy for the use of CAST in the therapeutic context may be to insert corrected exons into the intron before the mutated exon (FIG. 28). CAST may also be used to insert transgenes into "safe harbor" loci (29) or downstream of endogenous promoters so that the expression of transgenes of interest can benefit from endogenous gene regulation. The latter may be a strategy relevant for achieving cell type-specific transgene expression.

Figure 29:
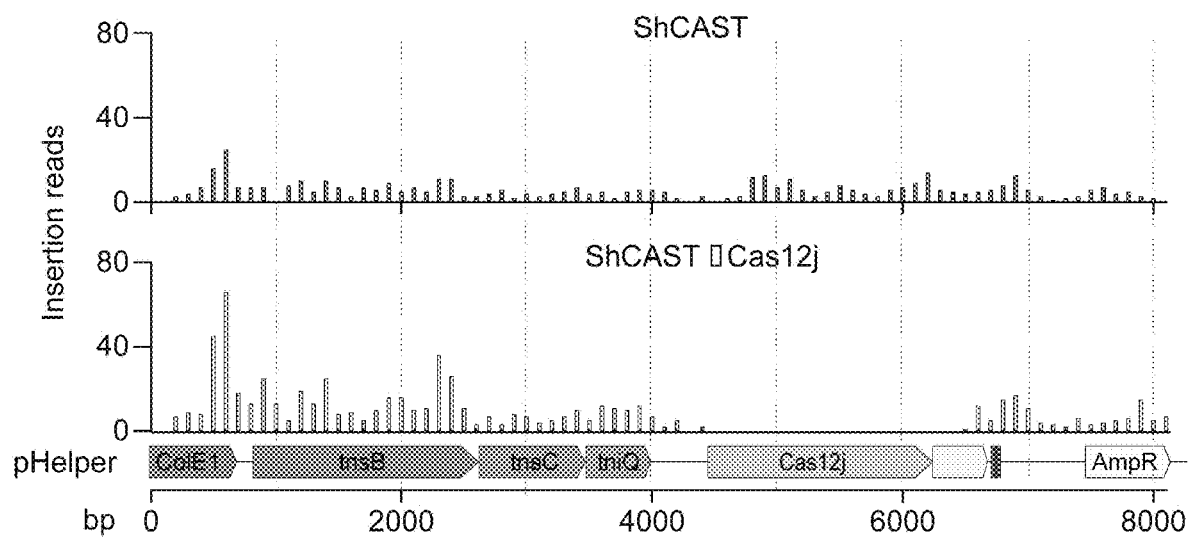
FIG. 29. ShCAST insertions into plasmids are independent of Cas12j. Sequence analysis of insertions into pHelper with wildtype ShCAST and a non-targeting sgRNA and ShCAST with Cas12j deleted.

The analysis indicates that ShCAST may be specific with few detected off-targets in the E. coli genome. Transposition may clearly occur via Cas12j-independent mechanisms. For example, the natural locations of the CAST loci in S. hofmanni and A. cylindrica are adjacent to tRNA genes and not at targets for the spacers contained within their CRISPR arrays (19, 26). Applicants also observed non-targeted insertions into pHelper in E. coli which was independent of Cas12j (FIG. 29) and reminiscent of TnsE-mediated Tn7 insertions into conjugal plasmids and replicating DNA (25).

In summary, this work identified a new function for CRISPR-Cas systems that did not require Cas nuclease activity and provided a strategy for the targeted insertion of DNA without engaging DNA double-strand break repair pathways, with particularly exciting potential for genome editing in eukaryotic cells.

EXAMPLE SPECIFIC REFERENCES

1. R. Barrangou, P. Horvath, A decade of discovery: CRISPR functions and applications. Nat Microbiol 2, 17092 (2017).
2. P. Mohanraju et al., Diverse evolutionary roots and mechanistic variations of the CRISPR-Cas systems. Science 353, aad5147 (2016).
3. L. A. Marraffini, CRISPR-Cas immunity in prokaryotes. Nature 526, 55-61 (2015).
4. L. Cong et al., Multiplex Genome Engineering Using CRISPR/Cas systems. Science 339, 819-823 (2013).
5. P. Mali et al., RNA-Guided Human Genome Engineering via Cas9. Science 339, 823-826 (2013).
6. B. Zetsche et al., Cpf1 is a single RNA-guided endonuclease of a class 2 CRISPR-Cas system. Cell 163, 759-771 (2015).
7. J. Strecker et al., Engineering of CRISPR-Cas12b for human genome editing. Nat Commun 10, 212 (2019).
8. F. Teng et al., Repurposing CRISPR-Cas12b for mammalian genome engineering. Cell discovery 4, 63 (2018).
9. M. Jasin, R. Rothstein, Repair of strand breaks by homologous recombination. Cold Spring Harb Perspect Biol 5, a012740 (2013).
10. J. L. Schmid-Burgk, K. Honing, T. S. Ebert, V. Hornung, CRISPaint allows modular base-specific gene tagging using a ligase-4-dependent mechanism. Nat Commun 7, 12338 (2016).
11. K. Suzuki et al., In vivo genome editing via CRISPR/Cas9 mediated homology-independent targeted integration. Nature 540, 144-149 (2016).
12. L. S. Qi et al., Repurposing CRISPR as an RNA-Guided Platform for Sequence-Specific Control of Gene Expression. Cell 152, 1173-1183 (2013).
13. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
14. N. M. Gaudelli et al., Programmable base editing of A*T to G*C in genomic DNA without DNA cleavage. Nature 551, 464-471 (2017).
15. K. Nishida et al., Targeted nucleotide editing using hybrid prokaryotic and vertebrate adaptive immune systems. Science 353, aaf8729-aaf8729 (2016).
16. C. Guynet et al., In vitro reconstitution of a single-stranded transposition mechanism of IS608. Mol Cell 29, 302-312 (2008).
17. O. Barabas et al., Mechanism of IS200/IS605 family DNA transposases: activation and transposon-directed target site selection. Cell 132, 208-220 (2008).
18. J. E. Peters, K. S. Makarova, S. Shmakov, E. V. Koonin, Recruitment of CRISPR-Cas systems by Tn7-like transposons. P Natl Acad Sci USA 114, E7358-E7366 (2017).
19. G. Faure et al., CRISPR-Cas in mobile genetic elements: counter-defense and beyond. Nat Rev Microbiol in press, (2019).
20. S. Shmakov et al., Diversity and evolution of class 2 CRISPR-Cas systems. Nat Rev Microbiol 15, 169-182 (2017).
21. R. J. Sarnovsky, E. W. May, N. L. Craig, The Tn7 transposase is a heteromeric complex in which DNA breakage and joining activities are distributed between different gene products. EMBO J15, 6348-6361 (1996).
22. J. E. Peters, N. L. Craig, Tn7: smarter than we thought. Nat Rev Mol Cell Biol 2, 806-814 (2001).
23. C. S. Waddell, N. L. Craig, Tn7 transposition: recognition of the attTn7 target sequence. Proc Natl Acad Sci USA 86, 3958-3962 (1989).
24. C. S. Waddell, N. L. Craig, Tn7 transposition: two transposition pathways directed by five Tn7-encoded genes. Genes Dev 2, 137-149 (1988).

25. J. E. Peters, N. L. Craig, Tn7 recognizes transposition target structures associated with DNA replication using the DNA-binding protein TnsE. Genes Dev 15, 737-747 (2001).
26. S. Hou et al., CRISPR-Cas systems in multicellular cyanobacteria. RNA Biol 16, 518-529 (2019).
27. F. J. Mojica, C. Diez-Villasenor, J. Garcia-Martinez, C. Almendros, Short motif sequences determine the targets of the prokaryotic CRISPR defence system. Microbiology 155, 733-740 (2009).
28. R. Bainton, P. Gamas, N. L. Craig, Tn7 transposition in vitro proceeds through an excised transposon intermediate generated by staggered breaks in DNA. Cell 65, 805-816 (1991).
29. M. Sadelain, E. P. Papapetrou, F. D. Bushman, Safe harbours for the integration of new DNA in the human genome. Nat Rev Cancer 12, 51-58 (2011).

Materials and Methods

Cyanobacteria RNA Sequencing

*Scytonema hofmanni* (UTEX B 2349) and *Anabaena cylindrica* (PCC 7122) were cultured in BG-11 media (ThermoFisher) at 25° C. with light periodicity of 14 hours on, 10 hours off. RNA was isolated using the miRNeasy Mini Kit (Qiagen) and treated with DNase I (NEB). rRNA was removed using RiboMinus (ThermoFisher). RNA libraries were prepared from rRNA-depleted RNA using NEBNext Small RNA Library Prep Set for Illumina (NEB).

RNA-Sequencing Analysis

RNA libraries were sequenced using a NextSeq 500/550 High Output Kit v2, 75 cycles (Illumina). Paired-end reads were aligned to their respective reference genomes using BWA (I) and entire transcripts were extracted using BEDTools. Resulting transcript sequences were analyzed using Geneious Prime 2019.0.4.

Generation of Heterologous Plasmids

Purified gDNA from *Scytonema hofmanni* and *Anabaena cylindrica* were prepped using the DNeasy Blood and Tissue Kit (Qiagen). Subsequently, CAST loci, excluding cargo genes, were amplified from the purified gDNA using KAPA HiFi HotStart ReadyMix (Kapa Biosystems) and cloned into pUC19. A lac promoter was placed in front of the CAST transposase genes and Cas12j gene, and a J23119 promoter was added in front of a shortened CRISPR array with two direct repeats. The first endogenous spacer in the array was replaced with the FnCpf1 protospacer 1 (PSP1) sequence (5'-GAGAAGTCATTTAATAAGGCCACTGTTAAAA-3' (SEQ ID NO:483)). The CAST open reading frames (ORFs) and downstream tracr regions were unchanged. Sequences of all bacterial expression plasmids can be found in Table 15.

PAM and Motif Screens

A randomized target PAM and insertion motif library was generated using synthesized ssDNA oligonucleotide (IDT) with 6 randomized bases upstream of PSP1 and 8 randomized bases starting 55 bp downstream of the spacer. Oligonucleotides were used to generate a PCR product for subsequent Gibson assembly (NEB) into pACYC184 vectors. Gibson products were electroporated into Endura Electro-Competent cells (Lucigen), recovered for 1 hour, and plated on chloramphenicol plates. Cells were harvested 16 hours after plating and plasmid DNA was harvested using a Maxi-prep kit (Macherey-Nagel). 100 ng of library target DNA was co-electroporated with 100 ng of both pHelper and pDonor into TransforMax EC 100D pir+*E. coli*. Cells were recovered for 1 hour and plated on ampicillin, kanamycin, and chloramphenicol-containing plates. Insertion products containing the randomized PAM sequence or motif sequence were amplified and sequenced using a MiSeq Reagent Kit v2, 300-cycle (Illumina). In addition, the PAM and motif sequences in the library targets were amplified and sequenced alongside insertion samples.

PAM and Motif Discovery Pipeline

For sequence verified insertion events, the randomized PAM region and motif regions were extracted, counted, and normalized to the total number of reads from the corresponding sample. The enrichment of a given randomized sequence was determined by its ratio in the insertion sample to its abundance in the library target. These ratios were used to create PAM wheels using Kronos Plot (github.com/marbl/Krona/wiki) (2). PAMs and motifs above a $\log_2$ enrichment threshold of 4 and 1, respectively, were collected and used to generate sequence logos.

Droplet Digital PCR (ddPCR)

ddPCR Supermix for Probes (BioRad), primers, product specific probes, and sample were combined into 20 µL reactions and droplets were generated using the QX200 Droplet Generator (BioRad). Insertion events were quantified using insertion PCR specific primers and a donor specific probe (Table 17). Targets were quantified using target specific PCR primers and a corresponding probe (Table 17). Thermal cycling conditions for ddPCR reactions were as follows: 1 cycle, 95° C., 10 min; 40 cycles, 94° C., 30 sec, 60° C., 1 min; 1 cycle, 98° C., 10 mins; 4° C. hold; 2° C./sec ramp for every step. ddPCR plates were sealed with a foil heat seal (BioRad) and read with a QX200 Droplet Reader. Absolute concentrations of inserts and targets were determined using QuantaSoft (v1.6.6.0320) and insertion frequency calculated by inserts/(inserts+targets).

*E. coli* Plasmid-Targeting Assays

Targeted transposition into target plasmids was performed by transformation of 5 ng each of pHelper, pInsert, and pTarget into One Shot Pir1 Chemically Competent *E. coli* (Invitrogen). Cells were recovered for 1 hour and plated on ampicillin, kanamycin, and chloramphenicol-containing plates. Cells were harvested 16 hours after plating and grown for 8 hours in LB media containing ampicillin, kanamycin, and chloramphenicol. Plasmid DNA was isolated using a Qiaprep Miniprep Kit (Qiagen), diluted approximately 500-fold, and quantified using ddPCR as described above.

Purification of shCAST Proteins

ShCAST genes were cloned into bacterial expression plasmids (T7-TwinStrep-SUMO-NLS-Cas12b-NLS-3×HA) and expressed in BL21(DE3) cells (NEB #C2527H) containing a pLysS-tRNA plasmid (from Novagen #70956). Cells were grown in Terrific Broth to mid-log phase and the temperature lowered to 20° C. Expression was induced at 0.6 OD with 0.25 mM IPTG for 16-20 h before harvesting and freezing cells at −80° C. Cell paste was resuspended in lysis buffer (50 mM TRIS pH 7.4, 500 mM NaCl, 5% glycerol, 1 mM DTT) supplemented with EDTA-free cOmplete protease inhibitor (Roche). Cells were lysed using a LM20 microfluidizer device (Microfluidics) and cleared lysate was bound to Strep-Tactin Superflow Plus resin (Qiagen). Resin was washed using lysis buffer and protein was eluted with lysis buffer supplemented with 5 mM desthiobiotin, with the exception of tniQ. The TwinStrep-SUMO tag was removed by overnight digest at 4° C. with homemade SUMO protease Ulp1 at a 1:100 weight ratio of protease to target. tniB, tniC, and Cas12j protein was diluted with 50 mM TRIS pH 7.4, 50 mM NaCl to a final concentration of 200 mM NaCl and purified using a HiTrap Heparin HP column on an AKTA Pure 25 L (GE Healthcare Life Sciences) with a 200 mM-1M NaCl gradient. Fractions containing protein were pooled and concentrated and loaded onto a Superdex 200 Increase column (GE Healthcare Life Sciences) with a final storage buffer of 25 mM TRIS pH 7.4, 500 mM NaCl, 0.5 mM EDTA, 10% glycerol, 1 mM DTT. tniQ was cleaved from Strep-Tactin Superflow Plus resin with SUMO protease Ulp1 overnight at 4° C. and loaded onto a Superdex 200 Increase column with a final storage buffer of 25 mM TRIS pH 7.4, 500 mM NaCl, 0.5 mM EDTA, 10% glycerol, 1 mM DTT. All proteins were concentrated to 1 mg/mL stocks and flash-frozen in liquid nitrogen before storage at −80° C.

In Vitro Transposition Assays

Purified proteins were diluted to 2 uM in 25 mM Tris pH 8, 500 mM NaCl, 1 mM EDTA, 1 mM DTT, 25% glycerol. All RNA was generated by annealing a DNA oligonucleotide containing the reverse complement of the desired RNA with a short T7 oligonucleotide or by adding the T7 promoter through PCR. In vitro transcription was performed using the HiScribe T7 High Yield RNA synthesis kit (NEB) at 37° C. for 8-12 hours and RNA was purified using Agencourt AMPure RNA Clean beads (Beckman Coulter).

In vitro transposition reactions were carried out with 50 nM of each protein where indicated, 20 ng of pTarget plasmid, 100 ng of pDonor, 600 nM final RNA concentration in a final reaction buffer of 26 mM HEPES pH 7.5, 4.2 mM TRIS pH 8, 50 ug/mL BSA, 2 mM ATP, 2.1 mM DTT, 0.05 mM EDTA, 0.2 mM $MgCl_2$, 28 mM NaCl, 21 mM KCl, 1.35% glycerol supplemented with 15 mM MgOAc2 as previously described for Tn7(3). Total reaction volumes were 20 uL and reactions were incubated for 2 hours at the indicated temperature and purified using Qiagen PCR Purification columns before bacterial transformation or PCR readout.

E. coli Genome-Targeting Assays 48 guides with NGTN PAMs were randomly chosen in non-coding regions of the E. coli genome (Table 17 and cloned into pHelper with the sgRNA configuration. 5 ng of pHelper constructs targeting the genome were transformed into Pir1 cells harboring pDonor, recovered for 15 minutes, and plated on ampicillin and kanamycin-containing plates. Successful insertion was identified by performing nested colony PCR using KAPA HiFi HotStart ReadyMix (Kapa Biosystems). The remainder of cells were harvested 16 hours after plating and gDNA was purified using DNeasy Blood and Tissue Kit (Qiagen) for further analysis.

Genome insertions were sequence verified by insertion-specific amplification and sequenced using a MiSeq Reagent Kit v2, 150-cycle (Illumina). Paired end reads were trimmed of donor sequence and mapped to the genome using BWA (1). Resulting sequences were used to determine insertion position relative to the guide sequence. Frequency of genome insertions was determined with ddPCR as described above with a guide specific forward primer (Table 17).

E. coli Specificity Analysis

Unbiased detection of transposition events was performed as previously described. Purified gDNA from E. coli genome targeting assays was tagmented with Tn5, followed by QIAquick PCR purification (Qiagen). Tagmented DNA samples were amplified using two rounds of PCR with KOD Hot Start DNA Polymerase (Millipore) using a Tn5 adapter-specific primer and nested primers within the DNA donor. The resulting libraries were sequenced using a NextSeq v2 kit, 75 cycle. Paired end reads were trimmed of donor sequence and mapped to the genome using BWA. Resulting sequences were used to determine the insertion position in the E. coli genome.

TABLE 17

DNA Sequences

| Protein | Accession | DNA Sequence |
| --- | --- | --- |
| ShTnsB (SEQ ID NO: 948) | WP_084763316.1 | atgaacagtcagcaaaatcctgatttagctgttcatcccttggcaattcctatggaaggcttactaggag aaagtgctacaactcttgagaagaatgtaattgccacacaactctcagaggaagcccaagtaaagctaga ggtaatccaaagtttactggaaccctgcgatcgcacaacttatgggcaaagttgcgggaagcagcagag aaactaaatgtatcgttgcgaacgcgtacaaaggttggtgaaaaactgggaacaagatggcttagtcggac tcactcaaacaagtagggctgataaaggaaaacaccgcattggtgagttttgggaaaacttcattaccaa aacctacaaggagggtaacaagggaagtaaacgtatgacccctaaacaagttgctctcagagtcgaggct aaagcccgtgaattaaaagactctaagccgcccaattacaaaaccgtgttacgggtattagcacccattt tggaaaagcaacaaaaagccaagagtatccgcagtcctggttggagaggaactacgctttcggttaaaac ccgtgaaggaaaagatttatcggttgattacagtaaccatgtttggcaatgtgaccatacccgcgtggat gtgttgctggtagatcaacatggtgaaattttaagtcgtccctggctaacaacagtaattgatacttact ctcgttgcattatgggtatcaacttgggctttgatgcacccagtttctgggtagtagcattagcgttacg ccatgcaattctaccaaagcgttacggttccgagtacaaactgcattgtgagtggggaacctatggaaaa ccagaacattttataactgatggcggtaaagactttcgctctaaccacttgagtcagattgggcgcaat tgggatttgtctgtcattacgcgatcgcccttctgaaggtggagtagtagaacgtcccttcaaaacatt aaatgaccaactattttcaacgcttcctgggtacaccggatctaatgtgcaggaacgcccagaagatgca gagaaggacgcaagacttactttgcgagaactagaacagttacttgtgcgttacatcgtagatcgttaca accaaagtattgatgcgcggatgggcgaccaaacgcgctttgacgcttgggaagcaggattgcctacagt gccagtaccaataccagaacgagatttggatatttgtttaatgaagcagtcacggcgcactgtgcaaaga ggtggttgttgcagtttcagaatttaatgtatcgggggaatatttggcaggttatgccggagaaactg tcaacttaaggtttgacccagagacattacaacaattttggtttatcgccaggaaaacaatcaggaagt atttctgactcgcgctcacgctcaaggtttggagacagagcaactggcattagatgaggctgaggcagca agtcgcagactccgtaccgcagggaaaactatcagtaaccaatcattattgcaagaagttgttgaccgcg atgctcttgtcgctaccaagaaaagccgtaaggagcgtcaaaaattggaacagactgttttgcgatctgc tgctgttgatgaaagtaatagagaatccttgccttctcaaatagttgaaccagatgaagtggaatctaca gaaacggttcactctcaatacgaagacattgaggtgtgggactatgaacaacttcgtgaagaatatgggt tttaa |
| ShTnsC (SEQ ID NO: 949) | WP_029636336.1 | atgacagaagctcaggcgatcgccaagcagtttgggtggggtaaaaccggatgatgagtggttacaagctg aaattgctcgtctcaaggggtaagagcattgtgcctttacagcaggtaaaaactctccatgattggttaga tggcaagcgcaaggcaagaaaatcttgccgagtagttggggaatcgagaactggcaagacagttgcttgt gatgcctacagatacaggcacaaacctcagcaggaagctggacgacctccaactgtgcctgtcgtttata ttcgacctcaccaaaaatgtggccccaaggatttgtttaaaaagattactgagtacctcaagtatcgggt aacaaagggactgtatctgattttcgagataggacgatagaagtactcaaggggttgtggcgtagagatg ctaattattgatgaagctgaccgtctcaagcctgaaacttttgctgatgtgcgagatattgccgaagatt |

TABLE 17-continued

DNA Sequences

| Protein | Accession | DNA Sequence |
|---|---|---|
| | | taggaattgctgtggtactggtaggaacagaccgtttggatgcggtaattaagcgggatgagcaggttct
cgaacgctttcgggcgcatcttcgctttggtaaattgtcgggagaggattttaagaacaccgtagaaatg
tgggaacaaatggttttgaaactgccagtatcttctaatctaaagagcaaggagatgctacggattctca
cgtcagcaactgaaggctacattggtcgccttgatgagattcttagggaagctgcaattcgttccttatc
aagaggattgaagaagattgacaaggctgttttacaggaagtagctaaggagtacaa |
| ShTniQ (SEQ ID NO: 950) | WP_029636334.1 | atgatagaagcaccagatgttaaaccttggctattcttgattaaaccctatgaaggggaaagcctgagcc
actttcttggcaggttcagacgtgccaaccatttatccgcaagtggattgggtactttggcaggaattgg
tgctatagtggcacgttgggaaagattttcattttaatcctcgccctagtcagcaagaattggaagcgatc
gcatctgtagtagaagtgGCAgctcaaaggttagcccagatgttaccgcctgctggagtgggaatgcagc
atgagccaattcgcttgtgtgggggcttgttatgccgagtcgccttgtcaccgaattgaatggcagtacaa
gtcggtgtggaagtgcgatcgccatcaactcaagattttagcaaagtgtccaaactgtcaagcaccttttt
aaaatgcctgcgctgtgggaggatgggtgctgtcacagatgtaggatgccgtttgcagaaatggcaaagc
tacagaaggtttga |
| ShCas12j (SEQ ID NO: 951) | WP_029636312.1 | atgagtcaaataactattcaagctcgacttatttcctttgaatcaaaccgccaacaactctggaagttga
tggcagattaaacacgccgttaattaacgaactgcttgccagttaggtcaacaccccgacttcgagaa
gtggcaacaaaagggtaaactcccgtctaccgttgtgagccagttatgtcaacctctcaaaactgaccct
cgctttgcaggtcagcccagccgtttatatatgtcggcaattcatattgtggactacatctacaagtcct
ggctggctatacagaaacggcttcaacagcagctagatggaaagacgcgctggctagaaatgctcaatag
cgatgctgaattagtagaacattagtggtgacacttagaggctattcgtgtgtcaaacgctgctgaaatttg
gcaatagctatgccagcatctgagtcagatagcgcttcacctaaagggaaaaaaggtaaaaggagaaa
aaccctcatcttctagccctaagcgtagttatccaagacattatttgacgcttaccaagaaacggaaga
tatcaagagccgtagcgccatcagctacctgttaaaaaatggctgcaaacttactgacaaagaagaagat
tcagaaaaatttgctaaacgtcgtcgtcaagttgaaatccaaattcaaaggcttaccgaaaagttaataa
gtcggatgcctaaaggtcgagatttgaccaatgctaaatggttggagacactcttgactgctacaaccac
tgttgctgaagacaacgcccaagccaaacgctggcaggatattctgttaactcgatcaagttctctccca
ttccccttgtttttgaaaccaacgaggatatggtttggtcaaagaatcaaaggtaggctgtgtgttc
acttcaatggcttaagcgatttaattttgaggtgtactgcggcaatcgtcaacttcactggtttcaacg
cttcctagaagaccaacagactaaacgcaaaagcaaaaatcagcattctagcggcttgttcacactcaga
aatggtcatctagtttggcttgaaggtgagggtaaaggggaaccttggaatcttcaccacttgacccttt
actgctgtgttgacaatcgcttgtggacagaggagggaacagaaatcgttcgccaagagaaagcagatga
aattactaaattcatcacaaacatgaagaagaaaagcgatctaagcgatacacagcaagctttgattcaa
cgtaaacaattcaacacttactcgaataaacaattcctttgagcgtcctagccaaccccttatcaaggtc
aatcacacatttgttggagtaagcctgggactagaaaaacctgccacagtagcagtagtagatgcgat
cgccaacaaagtcttggcttaccggagtattaaacaatacttggcgacaattacgaactgctaaatcgc
cagagacgacaacagcagtacctatctcacgaacgccacaaagcacaaaaaaacttctctcccaatcaat
ttggacatctgagttagggcaacatatagacagattattagctaaagcaattgtagcgttagcgagaac
ctacaaagctggcagtattgtcttgcccaagttaggggatatgcgggaggttgtccaaagtgaaattcaa
gctatagcagaacaaaaattcccggttatatggaaggtcagcaaaaatatgccaaacagtaccgggtta
atgttcatcggtggagctacggcagattaattcaaagcattcaaagtaaagcagctcaaacaggaattgt
gattgaggagggaaaacaacctattcgaggtagtccccacgacaaagcaaaggaattagcactttctgct
tacaatctccgcctaactaggcgaagttaa |
| AcTnsB (SEQ ID NO: 952) | AFZ56182.1 | atggcagacgaagaatttgaatttactgaaggaacgacgcaagttccagatgctattttgcttgacaaga
gtaattttgtgggtagatccatcccaaattattctgcaacgtcgataagacataaactgacatttaatct
aatccagtggctgctgaatctcccaaccgcactattaagtctcagagaaaacaggcagttgcaaatacc
cttgatgtttctactcgccaggtggaacgtcttctcaagcaatacgatgaagacaagttaagagagacag
caggaatagaacgagccgataagggaaaatatcgagttagcgaatattggcaaaacttcatcacaacaat
ctatgaaaagagtctgaaagaaaaaacatccaatatcaccagcatccatagttcgtgaagtgaagcgacac
gcaattgtggatcttgaacttaagctaggagaatatcctcatcaagccactgtcttatgaattttagatc
ctttaatcgagcaacagaaacgaaaacaagagttagaaatccgggttcgggatcttggatgacagtagt
aacacgagatggagagttacttagggctgacttagtaaccaaattattcagtgtgaccatactaaattg
gatgttcgcatagttgataatcatggcaattactgtctgatcgtccttggctaactactattgtggata
cttttcaagctgtgttgttggttttcgcttatggattaaacaaccggttctacagaggtggcttagc
tttaagacacgctatttttacctaaaaactaccctgaagattatcaactttaataagtcttgggatgtatgt
ggacacccctatcaatatttttttactgatggtggtaaagattttcgctcaaaacatctcaaagctattg
gtaagaaattaggatttcagtgtgaattacgcgatcgcccaccggaaggtggtattgtggaacggatttt
caaaactattaatactcaagttctcaaagagttacctggttatacaggggcaaatgttcaggaacgccca
gaaaatgcagagaaagaagcctgttaactattcaggattggataagattctcgctagtttcttttgtg
atatctataatcacgagcctatcctaaagagcctcgtgatacgagatttgaacgctggtttaagggtat
gggaggaaaactacctgaacctttggatgagcgagaattagatatttgttttgatgaagaagcccaacga
gttgttcaagctcatggatctattcaatttgaaaacctgatttatcgggagaatttctcaaagcacata
aaggtgaatatgtaacgctgagatatgatccgatcatatcctgagtttatatatctacagtggtgaaac
tgatgataatgcaggagaattttgggttatgctcatgccgttaatatggataccatgatttaagtata
gaagaattaaaagccctgaataaagagagaagtaatgctcgtaaggagcattttaactatgatgctttat
tagcattgggtaaacgtaaagaacttgtagaggaacggaagaggataaaaaggcaaaaagaaactcaga
acaaaagcgtctccgttctgcatccaagaaaaattccaatgttattgaactacgcaaaagtaggacttcc
aaatcttttgaagaaacaagaaatcaggaagttttaccagagagaattccagggaagaaatcaagcttg
agaagatagaacagcaaccacaggaaatctatcagcttcacctaacactcaagaagaagagagacataa
gttagttttctctaaccgtcaaaaaatttgaacaagatttggtaa |
| AcTnsC (SEQ ID NO: 953) | AFZ56183.1 | atggcgcaacctcaacttgcaactcaatctattgttgaagtcctagccccaaggttagacatcaaagctc
aaattgctaaaactattgatattgaagagatttttagagcttgttttatcactactgatcgggcttcgga
atgcttcagatggttagatgaattgcgtattctcaaacaatgtggtcgaatcattggaccaagaaatgtg
ggaaaaagcagagccgcgcttcactatcgagatgaggataaaaaaacgagtttcctatgtaaaggcttggt |

TABLE 17-continued

DNA Sequences

| Protein | Accession | DNA Sequence |
|---|---|---|
| | | ctgcatcgagttctaagcggctattttcacaaatcctgaaggatattaatcatgctgcaccaacaggtaa<br>acgacaggatttacgtccaagattagcgggtagtctgaactatttggattggaattggtgattatagat<br>aatgcggaaaatcttcaaaaagaagcactgctagacttgaaacaacttttttgaagagtgtaatgttccta<br>ttgttttagctggaggtaaggagttagatgatcttttacacgattgtgatttgttgactaatttcccaac<br>actctatgagtttgaacggttggaatatgatgattcaaaaaaacattaactacaattgaattggatgtt<br>ttatctcttccagaagcatctaatttagctgagggcaatattttgagatttagcagttagtacagaag<br>cacgaatgggaattttaatcaagatactaactaaggctgttttacattctctcaaaaatggatttcaccg<br>agttgatgaaagtattttagaaaaaattgctagtcgttatggcacaaaatatattcctctcaaaaacaga<br>aatagggattga |
| AcTniQ<br>(SEQ ID<br>NO: 954) | AFZ56184.1 | atggcacaaaatatattcctctcaaaaacagaaataggattgatgaagatgatgaaattcgcccaaagt<br>taggctatgttgaacctatgaggaggagagtattagtcattatctagggcgtttgcgacggtttaaggc<br>taacagcctaccgtcaggatactctttgggaaaaattgctggactcggtgcaatgatttcacgttgggag<br>aagctttatttcaatcctttcctactctacaagagttggaggctttgtcctctgtggtgggagttaatg<br>cagatagattaatagaaatgctcccctctcagggaatgacgatgaagcctagaccaattaggttatgtgg<br>ggcttgttatgcagaatctccttgtcatcggattgagtggcagtgtaaggatagaatgaaatgcgatcgc<br>cacaatttacgttattaataaaatgtactaattgtgaaactccttccgattcccgcagattgggtta<br>aaggtcaatgtcctcattgttccctgccttttgcaaagatggcgaaaaggcaaaggcgtgattag |
| AcCas12j<br>(SEQ ID<br>NO: 955) | AFZ56196.1 | atgagcgttatcacaattcaatgtcgcttggttgctgaagaagacagcctccgtcaactatgggaattga<br>tgagtgaaaaaaatacaccattcatcaatgaattttgctacagataggaaaacacccagaattgaaac<br>ctgagtagaaaaaggtagaataccggctgaattactcaaaacactgggtaactccctgaaaactcaagaa<br>ccttttactggacaacctggacgttttacacctcagcgattacttagtggattatctgtataaatcct<br>ggtttgctttacagaaacgcagaaagcagcaaatagaagggaaacagcgttggctaaaaatgctcaaaag<br>tgatcaagaacttgagcaagaaagtcaatctagcttagaagtaatccgtaataaagccactgaacttttt<br>agcaaatttacccctcagtccgatagcgaagcgctccgtaggaatcaaaatgacaaacagaaaaaggtaa<br>aaaagactaaaaaatccacaaaaccgaaaacatcttcaattttcaaaattttttttaagcacttacgaaga<br>agcggaagaacctcttactcgttgcgctcttgcatatctactcaaaaataactgtcaaattagtgaactg<br>gatgaaaacccagaagaatttaccagaaataagcgcagaaaagaaatagaaattgagcgattaaaagatc<br>aactccaaagtcgcatccccaaaggtagagatttgacaggagaagaatggttagaaaccttagaaattgc<br>caccttcaatgttccgcaaaatgaaaatgaagcaaaagcatgcaagcagcactttaagaaaaactgct<br>aatgttcccttcctgtagcttatgaatctaacgaggatatgacatggttaaagaatgataaaatcgtc<br>tctttgtacggttcaatggcttgggaaaacttacttttgagatttactgcgataagcgtcatttgcacta<br>cttccaacgcttttagaggatcaagaaattctacgcaatagtaaaaggcagcactcaagcagtttgttt<br>actctacgctcaggaagaatagcttggttgccaggtgaagaaaaaggtgaacattggaaagtaaatcaac<br>taaattttattgttctttagatactcgaatgctgactaccgaaggaactcaacaggtagttgaggagaa<br>agttacagcaattaccgaaattttaaataaaacaaaacagaaagatgatctcaacgataaacaacaagct<br>tttattactcgtcagcaatcaacactagctcgaattaataaccttttcctcgtcccagtaatcaaacctaatt<br>atcaaggtaaatcttctatcctcataggtgttagttttggactagaaaaaccagtcacagtagcagtcgt<br>agatgttgttaaaaataaagttatagcttatcgcagtgtcaaacaactacttggtgaaaactataatcttc<br>tgaatcgtcagcgacaacaacagcaacgcctatctcacgaacgccacaaagcccaaaaacaaatgcac<br>ccaactctttggtgaatctgaattaggacaatatgtggatagattgttaagcagatgcaattattgcgat<br>cgctaaaaaatatcaagctggcagtatagttttacccaaactccgcgatatgcgagagcaaatcagcagt<br>gaaattcaatccagagcagaaaatcaatgccctggttacaaagaaggccaacaaaaatacgccaaagaat<br>atcgaataaacgttcatcgctggagttatggacgattaatcgagagtatcaaatcccaagcagcacaagc<br>tggaattgcaattgaaactgaaaacagtcaatcagaggcagtccacaagaaaaagcacgagatttagcc<br>gtctttacttaccaagaacgtcaagctgcgctaatttag |

TABLE 18

RNA Sequences

| RNA | Sequence (5' to 3') |
|---|---|
| ShCas12j tracrRNA1<br>(SEQ ID NO: 484) | AGGUGCGCUCCCAGCAAUAAGGGCGC<br>GGAUGUACUGCUGUAGUGGCUACUGA<br>AUCACCCCCGAUCAAGGGGGAACCCU<br>CCC |
| ShCas12j tracrRNA2<br>(SEQ ID NO: 485) | AGACAGGAUAGGUGCGCUCCCAGCAA<br>UAAGGGCGCGGAUGUACUGCUGUAGU<br>GGCUACUGAAUCACCCCCGAUCAAGG<br>GGGAACCCUCC |
| ShCas12j tracrRNA3<br>(SEQ ID NO: 486) | AAAUACAGUCUUGCUUUCUGACCCUG<br>GUAGCUGCUCACCCUGAUGCUGCUGU<br>CAAUAGACAGGAUAGGUGCGCUCCCA<br>GCAAUAAGGGCGCGGAUGUACUGCUG<br>UAGUGGCUACU |
| ShCas12j tracrRNA4<br>(SEQ ID NO: 487) | AAAUACAGUCUUGCUUUCUGACCCUG<br>GUAGCUGCUCACCCUGAUGCUGCUGU<br>CAAUAGACAGGAUAGGUGCGCUCCCA<br>GCAAUAAGGGCGCGGAUGUACUGCUG<br>UAGUGGCUACUGAAUCACCCCCGAUC<br>AAGGGGGAACCCUC |
| ShCas12j tracrRNA5<br>(SEQ ID NO: 488) | UUAAAUGAGGGUUAGUUUGACUGUAU<br>AAAUACAGUCUUGCUUUCUGACCCUG<br>GUAGCUGCUCACCCUGAUGCUGCUGU<br>CAAUAGACAGGAUAGGUGCGCUCCCA<br>GCAAUAAGGGCGCGGAUGUACUGCUG<br>UAGUGGCUACUGAAUCACCCCCGAUC<br>AAGGGGGAACCCUC |

TABLE 18-continued

RNA Sequences

| RNA | Sequence (5' to 3') |
|---|---|
| ShCas12j tracrRNA6 (SEQ ID NO: 489) | AUAUUAAUAGCGCCGCAAUUCAUGCUGCUUGCAGCCUCUGAAUUUUGUUAAAUGAGGGUUAGUUUGAUAAAUACAGUCUUGCUUUCUGACCCUGGUAGCUGCUCACCCUGAUGCUGCUGUCAAUAGACAGGAUAGGUGCGCUCCCAGCAAUAAGGGCGCGGAUGUACUGCUGUAGUGGCUACUGAAUCACCCCCGAUCAAGGGGAACCC |
| ShCas12j sgRNA6.1* (SEQ ID NO: 490) | AUAUUAAUAGCGCCGCAAUUCAUGCUGCUUGCAGCCUCUGAAUUUUGUUAAAUGAGGGUUAGUUUGACUGUAUAAAUACAGUCUUGCUUUCUGACCCUGGUAGCUGCUCACCCUGAUGCUGCUGUCAAUAGACAGGAUAGGUGCGCUCCCAGCAAUAAGGGCGCGGAUGUACUGCUGUAGUGGCUACUGAAUCACCCCCGAUCAAGGGGAACCCUCCAAAAGGUGGGUUGAAAGnnnnnnnnnnnnnnnnnnnnnnnn |
| ShCas12j sgRNA6.2* (SEQ ID NO: 491) | AUAUUAAUAGCGCCGCAAUUCAUGCUGCUUGCAGCCUCUGAAUUUUGUUAAAUGAGGGUUAGUUUGACUGUAUAAAUACAGUCUUGCUUUCUGACCCUGGUAGCUGCUCACCCUGAUGCUGCUGUCAAUAGACAGGAUAGGUGCGCUCCCAGCAAUAAGGGCGCGGAUGUACUGCUGUAGUGGCUACUGAAUCACCCCCGAUCAAGGGGAACCCUAAAUGGGUUGAAAGnnnnnnnnnnnnnnnnnnnnnn |
| ShCas12j crRNA* (SEQ ID NO: 492) | AAGGAGGGAAGAAAGnnnnnnnnnnnnnnnnnnnnnnnn |

*23 nt guide sequences added to the 3' end of sgRNA and crRNA

TABLE 19

Genomic Targets
(SEQ ID NO: 493-636, where guide sequence is SEQ ID NO: 493, forward primer
is SEQ ID NO: 494, and reverse primer is SEQ ID NO: 495, etc.)

| Protospacer | PAM | Guide sequence (24 nt) | Forward primer | Reverse primer | Position |
|---|---|---|---|---|---|
| 2 | TGTG | TCAGAAGGTTAGCATCAAATGAT | AGATAACCGGGCACGTTTTT | TTCCTCCACATCCACTGTCT | 37315 |
| 3 | GGTA | TGTGAAGTAATACCCTAACCACC | GAGCCGGTGTGGAATGGTAA | ATTCTGGCGCTTGCTACCTT | 4455464 |
| 4 | CGTT | TTACATGTCCTGTACCCGGCAGA | ACGAAAGGCAGGTGAGAAGG | ACCATTCTCACCCGGCAATT | 61356 |
| 5 | CGTT | ATAGTGAATCCGCTTATTCTCAG | ACGTTCGAAAGGCGTACCAA | TGAGTGCCATTGTAGTGCGA | 1445845 |
| 6 | AGTG | GGATTCACACAACGAAACAATTA | CAGGATCCAGGATTCACGGG | AACCGGGTATTCCACACACC | 208056 |
| 7 | CGTT | TATTGCGAAGGGAGGGTGACGAA | TTGGTAGACGCGCTAGCTTC | TCGGTTTCGCCATCACATGA | 647688 |
| 8 | CGTT | CTGTGCCAAAAGCGGAAGTTGGA | AGCCAGAAATATGCCGAGCC | GGCAGACCAGAAAGCGTTTG | 1855018 |
| 9 | AGTT | CTGTAACGTAATCATTAACATGC | GCGGCCGCCAATTTTAGTTT | GCTCGGCATATTTGTCTGCG | 853988 |
| 10 | AGTC | TCAGACCTATTTGGCCGGTAATC | CAGATTGCCGCGGCTTTAAT | GTCCCAGTCCGATCTCTTGC | 2762104 |
| 11 | GGTA | ATGCCGGTCATTCCGGGGTTTTG | CGTTTCGTTTTCCGGTGCTT | AAGAAGCCTCACCACAACCC | 164858 |
| 12 | CGTT | TTAGGATAATTGGAATGAATATC | CGCGTCTTATCAGGCCTACA | ACCCAAAAACATTTCGGGCG | 393437 |
| 13 | TGTA | TTCAAAAGAGTATAAATGCCTGA | TGGGTTGAACATAACGCCGA | GCAAGTAAGCCCGCAATAGC | 1343329 |
| 14 | TGTG | TTTGCGGCATTAACGCTCACCAG | GAACGGCCTCAGTAGTCTCG | TGTTTAGAGTGTTCCCCGCG | 1726131 |
| 15 | TGTT | ACCCTCTTAAACTATCCCACTAA | AAGGCTGGGAAATCAGACGG | TATCTGCAAAGTCGCTGGGG | 3058735 |
| 16 | TGTC | AACCTCACTACTATCGAAGACTC | CGATTGGCATTAACCCGCTT | AAACGGCACATTCAACTGGC | 2167400 |
| 17 | AGTA | TAAAAAACGAACGATAACCGTGA | GCACAACACTGCCTGAAACA | GATGAACACGCGGACGAGTA | 2665227 |
| 18 | GGTT | GAGACTGTTGATAAAACGTAAAA | CATCAGCATTCCTGGCCGTA | ACGCCCGTGACAGTAAACAT | 999636 |
| 19 | AGTC | AGATGTTATTTTTTACTCACAAC | CGGGTGAATAGAGGGCGTTT | TCAGGCACGCACTTATAGCA | 4541043 |
| 20 | AGTC | GTTCTGTACACTTTGTTTTGTCA | GCTCGACGCATCTTCCTCAT | GGACAGAGCCGACAGAACAA | 87136 |
| 21 | GGTA | AAGTTTGGTAGATTTTAGTTTGT | ACACAGGTTTATCCCCGCTG | CGCCTCTGAAAACTCCTCCA | 1725870 |
| 22 | TGTG | TTAATGAAACCTTCTTGACGCTG | CTGGCGCTCATCAACAATCG | CAATTTTGCCTTCCCCGAGC | 1435660 |
| 23 | CGTT | TAGCTTATATTGTGGTCATTAGC | CGACCGACGATTATCCCCTG | AGCACGAGGGTCAGCAATAC | 259290 |
| 24 | CGTT | ACCACCTCAAGCTATGCCGCCAG | TTGGTAGGCCTGATAAGCGC | GTAGCAGATGACCTCGCCTC | 550349 |

TABLE 19-continued

Genomic Targets
(SEQ ID NO: 493-636, where guide sequence is SEQ ID NO: 493, forward primer
is SEQ ID NO: 494, and reverse primer is SEQ ID NO: 495, etc.)

| Protospacer | PAM | Guide sequence (24 nt) | Forward primer | Reverse primer | Position |
|---|---|---|---|---|---|
| 25 | TGTC | TATTCATCGTGTTGATAAGATAT | TGTGATGTTCTACGGGCAGG | CTCAGCGATCACCCGAAACT | 964477 |
| 26 | GGTC | TTTACTTGCTCATCGTTATAATT | TTAAACCGTGGGAAGGAGGC | TTTTGCGAGGCGTTTTCCAG | 551608 |
| 27 | AGTA | AAAACTGCTTCATAGCGCGGATT | GCAGTATAAAAAGCGCGCCA | GCTGTTGATTGACGCCAGTG | 1707979 |
| 28 | GGTT | TTTTATACCTGTAGATCATCATA | CAGGTGTCAGGTCGGAAACA | GCCGATAGTGTTCCTTGCCT | 1647991 |
| 29 | AGTT | CTCTTCGGACTTCGCGGGACAAA | TTTGTTAGTGGCGTGTCCGT | TTTGGCGGCTTTGATTTCCG | 1874378 |
| 30 | AGTC | TGAGTTATTTTTGTAGGGCTATA | AGTTTGCGGGTGATGAGAG | AATGACACACAAGACCAGCT | 4077502 |
| 31 | GGTA | ACGCCGTGAAAAGACGGGCTTAC | GGTCAGCCGATTTTGCATCC | GAAATGTCTTCAGGCGTGGC | 160388 |
| 32 | GGTA | ACCAGTTCAGAAGCTGCTATCAG | TCATGGCATTGCTGACGACT | CTGTCTGTGCGCTATGCCTA | 4587210 |
| 33 | CGTT | TTGTTAAAAAATGTGAATCACTT | GTTCTTCAGCAGGCGGGATA | GATGACGAGTGGTACTCCGC | 2556691 |
| 34 | TGTA | GTCTGCGATCCTGCCAGCAAATA | GGAGAGGCTTTCCCGTTTCA | TAGACTGCTTGCATGGCGAA | 2470836 |
| 35 | CGTA | ATTTTGGTGAGACCCAAAATCGA | GCTCCACTTTTCCACGACCA | GTGGTCTGATCCAGCGTTGA | 2991491 |
| 36 | TGTG | GATATTGTGATACACATTGAGGT | TGTGGCGAAGTTGAGATACCA | ACTATCTGAACTCTTCGTGGCT | 4562646 |
| 37 | TGTC | AGAAGGTTAGCATCAAATGATAA | GCATTCTGCGGGAAGGGATA | TTTTGCAGCATCCTGGCAAC | 37317 |
| 38 | GGTG | GATGGAAAGGTGATTGAAAACTC | AACCAGCGTTGACCATTTGC | ATAACTTCCAGTGGGCGTGG | 994483 |
| 39 | GGTT | TTACCCCTGTTACACGGGAAGTG | AGTAGTTCTGACAACGGGCG | CAACTCCGCTGGCAGAAAAG | 41015 |
| 40 | TGTC | AATGGGTGGTTTTTGTTGTGTAA | CAAATTATACGGTGCGCCCC | TCGGCGCTAAGAACCATCAT | 707736 |
| 41 | AGTT | TTGTCAGATATTACGCCTGTGTG | TATCCACCCGTGCGATTACG | CCAGAATGACCTCGGCAACT | 2687062 |
| 42 | AGTG | ACTATAGACTATCCGGGCAATGT | TGAGTGCCAGAATCTTGCGT | ACGTACTTCGCCACCTGAAG | 188387 |
| 43 | GGTG | ATTTTGTGATCTGTTTAAATGTT | GAGCGAAAACAGCAGCCATC | GTCATGATTGGCCTGCGTTC | 1138064 |
| 44 | TGTG | TCTGTAAATCACGACAATGGGTG | AGTCGGTGAATGAGCCACTG | GCAGTTGGGGTAAGTCGTCA | 1938877 |
| 45 | AGTC | ACTGCCCGTTTCGAGAGTTTCTC | GCAGGCTCGGTTAGGGTAAG | GGCTAACGTGGCAGGAATCT | 470870 |
| 46 | TGTA | GGCCGGACAAGACGTTTATCGCA | TGTAGGCCTGATAAGACGCG | TGAAGGGGTACGAGTCGACA | 4225144 |
| 47 | AGTG | GTGCTGATAGGCAGATTCGAACT | AGGTAGCCGAGTTCCAGGAT | TACGGTAGTGATTGCAGCGG | 453402 |
| 48 | AGTT | GGTGGCTCTGGCTGGAGTGAGAG | CCTCCGCCAGCTGAAGAAAT | CCAGACGGGTTTCATCAGCA | 982236 |
| 49 | AGTT | ATAGCGATCCCTTGCTGAAAATA | GTCAGGTAGCCAGAACACCC | GCCGGGATACGTTCCTTCTT | 762880 |

TABLE 20

| ddPCR Probes | |
|---|---|
| Insert Probe | CTGTCGTCGGTGACAGATTAATGTCATTGTGAC (SEQ ID NO: 637) |
| Target Probe | TGGGCAGCGCCCACATACGCAGCGATTTC (SEQ ID NO: 638) |

SUPPLEMENTARY REFERENCES

1. H. Li, R. Durbin, Fast and accurate short read alignment with Burrows-Wheeler transform. Bioinformatics 25, 1754-1760 (2009).
2. R. T. Leenay et al., Identifying and Visualizing Functional PAM Diversity across CRISPR-Cas systems. Molecular Cell 62, 137-147 (2016).
3. R. J. Bainton, K. M. Kubo, J. N. Feng, N. L. Craig, Tn7 transposition: target DNA recognition is mediated by multiple Tn7-encoded proteins in a purified in vitro system. Cell 72, 931-943 (1993).
4. J. Strecker et al., Engineering of CRISPR-Cas12b for human genome editing. Nat Commun 10, 212 (2019).

Example 9—deadCas+Single Strand Transposases

To harness single-strand transposases for precise DNA insertions.

The binding of Cas9 and its guide RNA to target DNA results in the formation of an R-loop[1], exposing a short stretch of single-stranded DNA.

To facilitate precise DNA insertions, Applicants investigated the HUH family of bacterial transposases which transpose using single-strand DNA intermediates[3-5]. These enzymes can break and rejoin DNA autonomously and can insert circular donor molecules into single-stranded DNA independent of host repair machinery[3-5]. Targeting these enzymes through fusion to Cas9 allowed for DNA integration in the exposed DNA strand, and the use of the Cas9$^{D10A}$ nickase mutant resulted in a cut only on the opposite strand and facilitate fill-in synthesis (FIG. 31).

First, Applicants harnessed the transposase TnpA from the *Helicobacter pylori* insertion sequence IS608 which inserted a single-strand donor into positions 5' of a TTAC sequence[3-5] and which was reprogrammed to target alternative sites[6]. Applicants created fusions of TnpA$_{IS608}$ to the N- and C-termini of Cas9$^{D10A}$ for expression in HEK293 cells and for protein production in *Escherichia coli*. Applicants performed in vitro reactions with both mammalian lysate and purified protein using DNA substrates to optimize protein design including orientation and peptide linker length.

Applicants next identified related orthologs to TnpA$_{IS608}$ and test for increased activity and specificity of DNA insertion. Highly active transposases may be under negative selection in nature as they might compromise host viability. Applicants therefore performed protein BLAST searches to identify a consensus TnpA sequence and tested mutations that revert TnpA$_{IS608}$ to the consensus sequence for increased insertion efficiency.

Once optimized in vitro, Applicants introduced TnpA-Cas9$^{D10A}$ constructs into mammalian cells using lipid-based DNA transfection and nucleofection of purified protein-DNA complexes to test for genomic integration and long-term stability at a variety of sites and genomic contexts. While the on-target insertion frequency could easily be measured by next-generation sequencing, Applicants also performed genome fragmentation with Tn5 to identify all insertion sites in an unbiased manner. This characterization was important to determine the specificity of integration. To reduce potential off-target integrations, these tools were further be combined with Cas9 variants that increase target specificity[8] or with new CRISPR proteins being characterized in the Zhang laboratory.

The successful development of this technology provided a powerful method to integrate DNA into the genome of mammalian cells. This process was independent of host DSB repair factors and should only require fill-in DNA synthesis from the host, a process that occurred during nucleotide excision repair even in non-dividing cells. The ability to precisely integrate transgenes may be used to supply tumor suppressor genes to cells without the random integration of existing method, for example viral integration or double-strand transposase methods like piggyBac. The integration of DNA at splice acceptor sites using TnpA-dCas9 fusions could also allow for repair of endogenous gene mutations by providing replacement exons.

The methods here were used to for precise inserting DNA independent of cellular repair pathways.

The results are shown in FIGS. 30A-41.

Figure 30A:
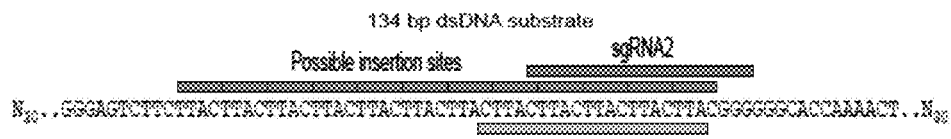
FIGS. 30A-30D.
Figure 30B:
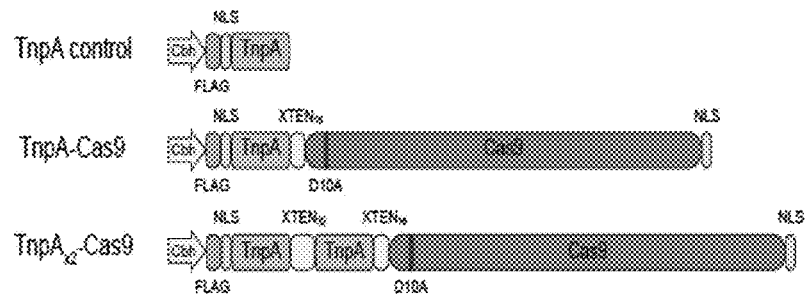
Figure 30C:
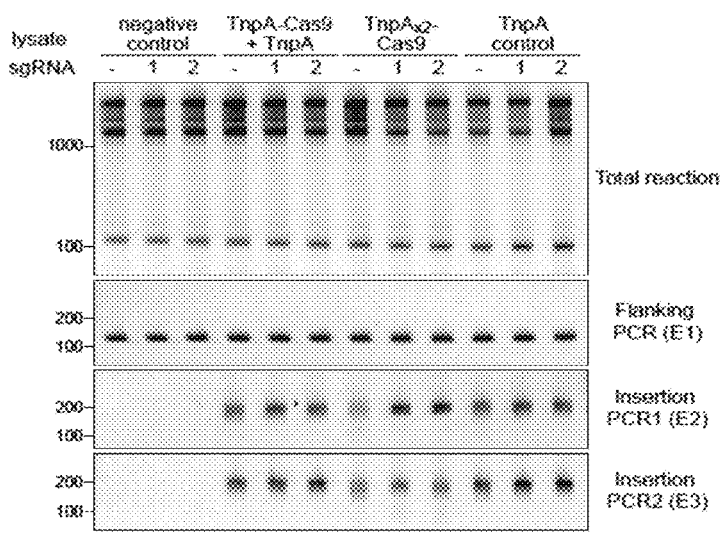
Figure 30D:
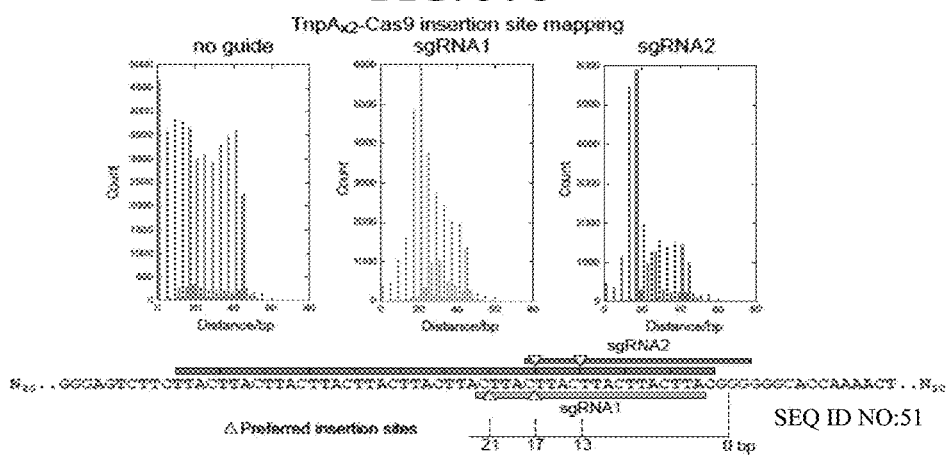

FIG. 30A shows a schematic of a134 bp double-strand DNA substrate for in vitro transposases reactions. The transposase TnpA from *Helicobacter pylori* IS608 inserts single-stranded DNA 5' to TTAC sites. FIG. 30B shows a schematic of constructs for expression in mammalian cells. TnpA from IS608 functions as a dimer and constructs were made fusing a monomer of TnpA to Cas9-D10A (TnpA-Cas9), a tandem dimer of TnpA fused to Cas9-D10A (TnpAx2-Cas9), or free TnpA alone. XTEN16 and XTEN32 are protein linkers of 16 and 32 amino acids respectively. FIG. 30C shows insertion of foreign DNA with mammalian cell lysates containing TnpA. In vitro reactions with the 134 bp substrate in panel a, synthesized sgRNA, and lysates from mammalian cells expressing the indicated constructs. The provided donor included in all reactions is a 200 bp circular ssDNA molecule containing the left and right hairpins of IS608 and 90 bp foreign internal DNA. PCR E1 amplifies the complete substrate, while the insertion-specific PCRs, E2 and E3, contain one flanking primer and one primer specific to the donor sequence. The observed products are consistent with donor insertion and match the predicted sizes of 183 bp (E2), and 170 bp (E3). The inability to detect a 334 bp band in the total reaction, or in PCR E1 suggests that the overall rate of insertion is low. PCRs E2 and E3 indicate donor insertion when TnpA is present in any lysate which is independent of sgRNA. FIG. 30D shows NGS sequencing of E2 products indicating the insertion site of donor DNA. Non-specific integration by TnpA occurs at all possible integration sites in the array indicated by peaks 4 bp apart. Incubation with TnpAx2-Cas9-D10A lysate led to the targeted integration of single-strand DNA 5' to positions 15 and 19 bp from the PAM in a manner that was dependent on presence and target site of guide RNA.

Figure 31A:
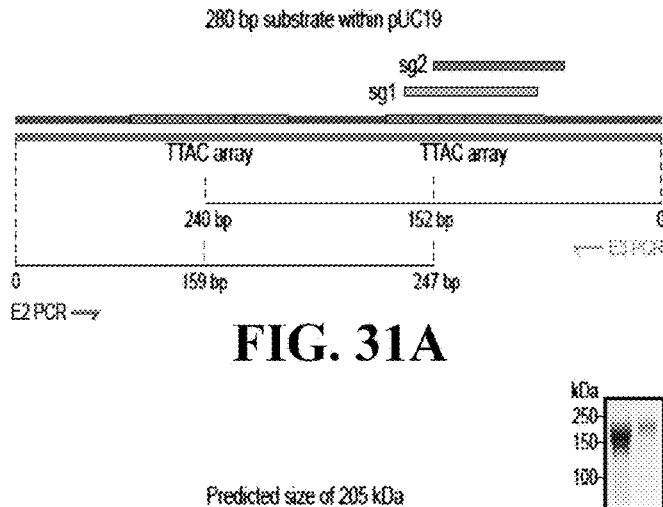
FIGS. 31A-31D.
Figure 31B:
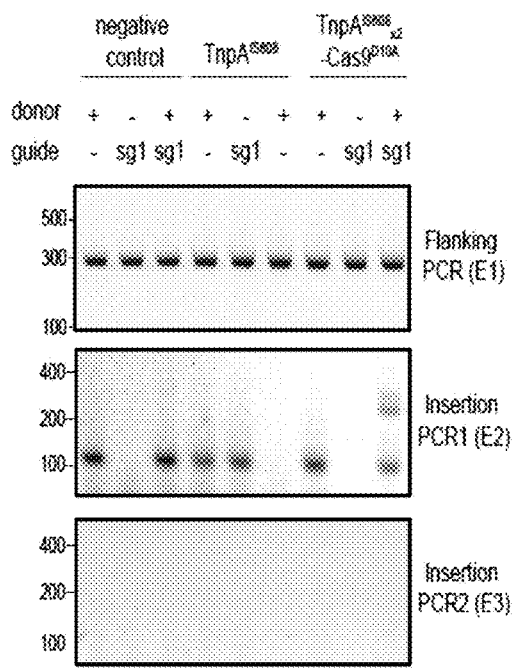
Figure 31C:
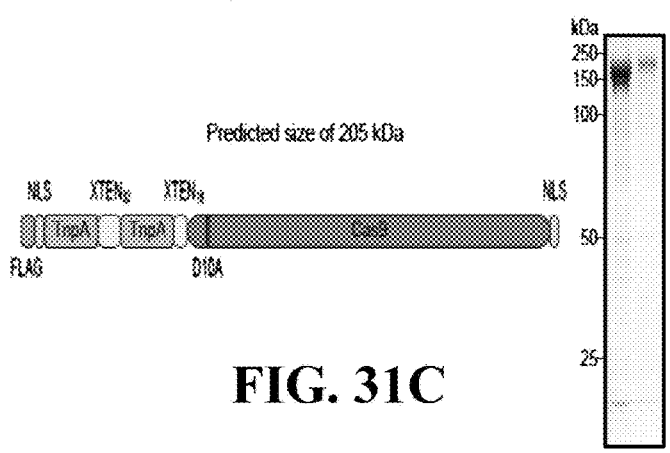
Figure 31D:
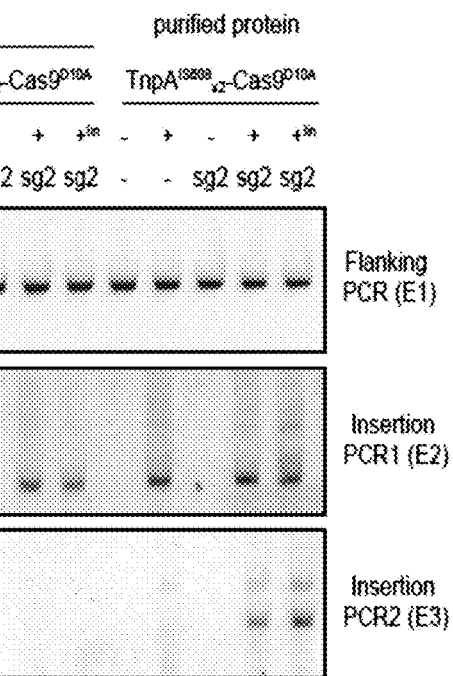

FIG. 31A shows a schematic of a 280 bp double-strand DNA substrate for in vitro transposases reactions cloned into pUC19. The substrate contains two array of TTACx6 TnpA insertion sites, one which is targeted by Cas9 sgRNAs. Plasmid substrates were treated with T5 exonuclease to remove contaminating single-strand DNA. FIG. 31B shows insertion of foreign DNA with mammalian cell lysates containing TnpA. In vitro reactions with the 280 bp substrate in panel a, synthesized sgRNA, and lysates from mammalian cells expressing the indicated constructs. The donor DNA is a 160 bp circular ssDNA molecule containing the left and right hairpins of IS608 and 90 bp foreign DNA. PCR E1 amplifies the complete substrate, while the insertion-specific PCRs, E2 and E3, contain one flanking primer and one primer specific to the donor sequence. A 250 bp PCR product is detectable after incubation with TnpA$_{IS608\ x2}$-Cas9$_{D10A}$, but not TnpA alone, and is dependent on the presence of donor and sgRNA. FIG. 31C shows purification of recombinant TnpA$_{IS608\ x2}$-Cas9$_{D10A}$ from *E. coli* which matches. Coomassiestained SDS-PAGE showing two dilutions of purified protein. FIG. 31D shows comparison of in vitro DNA insertions using mammalian cell lysates versus purified protein. In vitro reactions with the 280 bp substrate in panel a, synthesized sgRNA, and lysates from mammalian cells expressing the indicated constructs or purified protein from panel c. The donor DNA was a 160 bp circular ssDNA molecule containing the left and right hairpins of IS608 and 90 bp foreign DNA. PCR E1 amplified the complete substrate, while the insertion-specific PCRs, E2 and E3, contained one flanking primer and one primer specific to the donor sequence. E2 products of 250 bp were weakly visible upon addition of TnpA$_{IS608\ x2}$-Cas9$_{D10A}$ lysate and protein while PCR E3 detected more robust insertion products. The darker band at 152 bp was consistent with directed insertions to the Cas9-targeted TTAC array in contrast to the 240 bp band, predicted to be the size for non-targeted insertions at the second TTAC array. The 152 bp E3 insertion-specific PCR products were dependent on donor DNA and sgRNA.

FIG. 32 shows a schematic demonstrating an exemplary method. Cas9 was used to expose a single-stranded DNA substrate. A HUH transposase was tethered to insert single-stranded DNA. The opposing strand was nicked and allowed to fill-in DNA synthesis.

Figure 33:
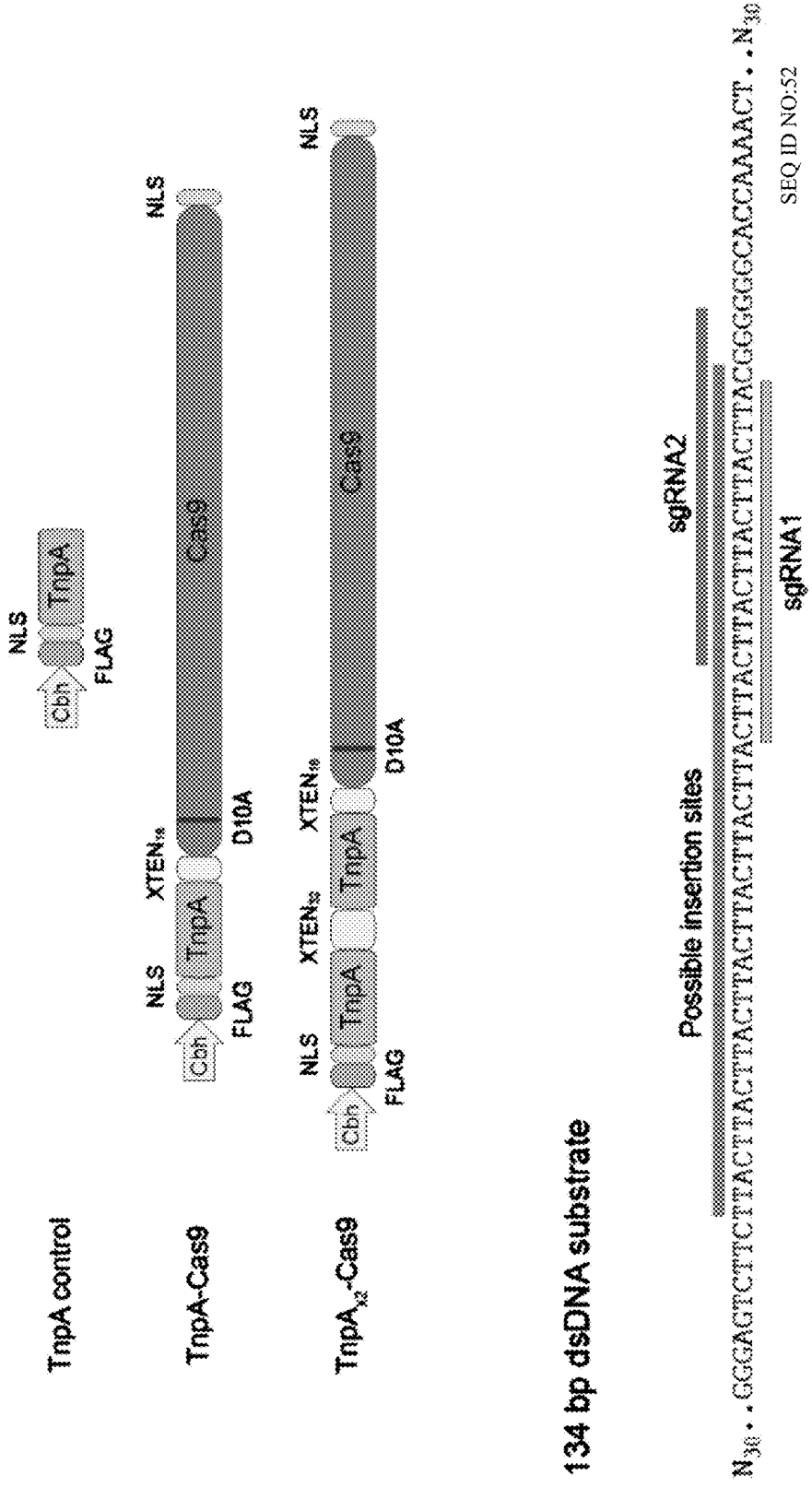
FIG. 33 shows a schematic of mammalian expression constructs with TnpA from *Helicobacter pylori* IS608 fused to D10A nickase Cas9. XTEN16 and XTEN32 are two different polypeptide linkers. Schematic of Substrate 1, a double-stranded DNA substrate (complementary strand not shown) with an array of twelve TTAC insertion sites and targeted by two Cas9 sgRNAs (SEQ ID NO:52).
Figure 34:
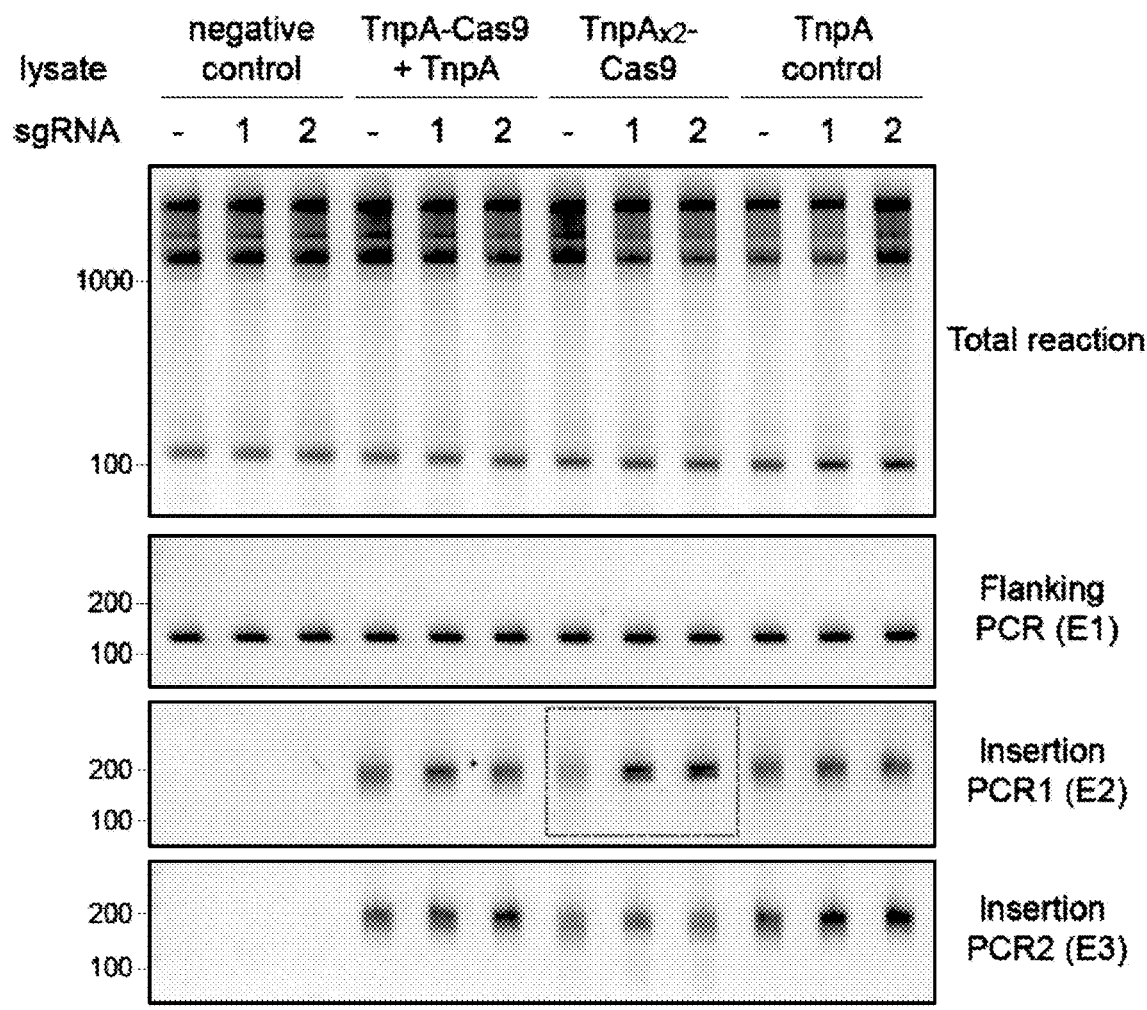
FIG. 34 shows in vitro insertion reactions. Substrate 1 was incubated with the indicated mammalian cell lysates, a 200 bp circular single-stranded DNA donor, and sgRNAs. PCRs E2 and E3 detect insertion products by spanning the insertion junction with one donor-specific primer.

FIG. 33 shows a schematic of mammalian expression constructs with TnpA from *Helicobacter pylori* IS608 fused to D10A nickase Cas9. XTEN16 and XTEN32 are two different polypeptide linkers. Schematic of Substrate 1, a double-stranded DNA substrate (complementary strand not shown) with an array of twelve TTAC insertion sites and targeted by two Cas9 sgRNAs. Cell lysate was from transfected HEK293 cells. The step used a 134 bp dsDNA donor (annealed oligos) and a 200 bp circular ssDNA donor FIG. 34 shows in vitro insertion reactions. Substrate 1 was incubated with the indicated mammalian cell lysates, a 200 bp circular single-stranded DNA donor, and sgRNAs. PCRs E2 and E3 detect insertion products by spanning the insertion junction with one donor-specific primer.

Figure 35:
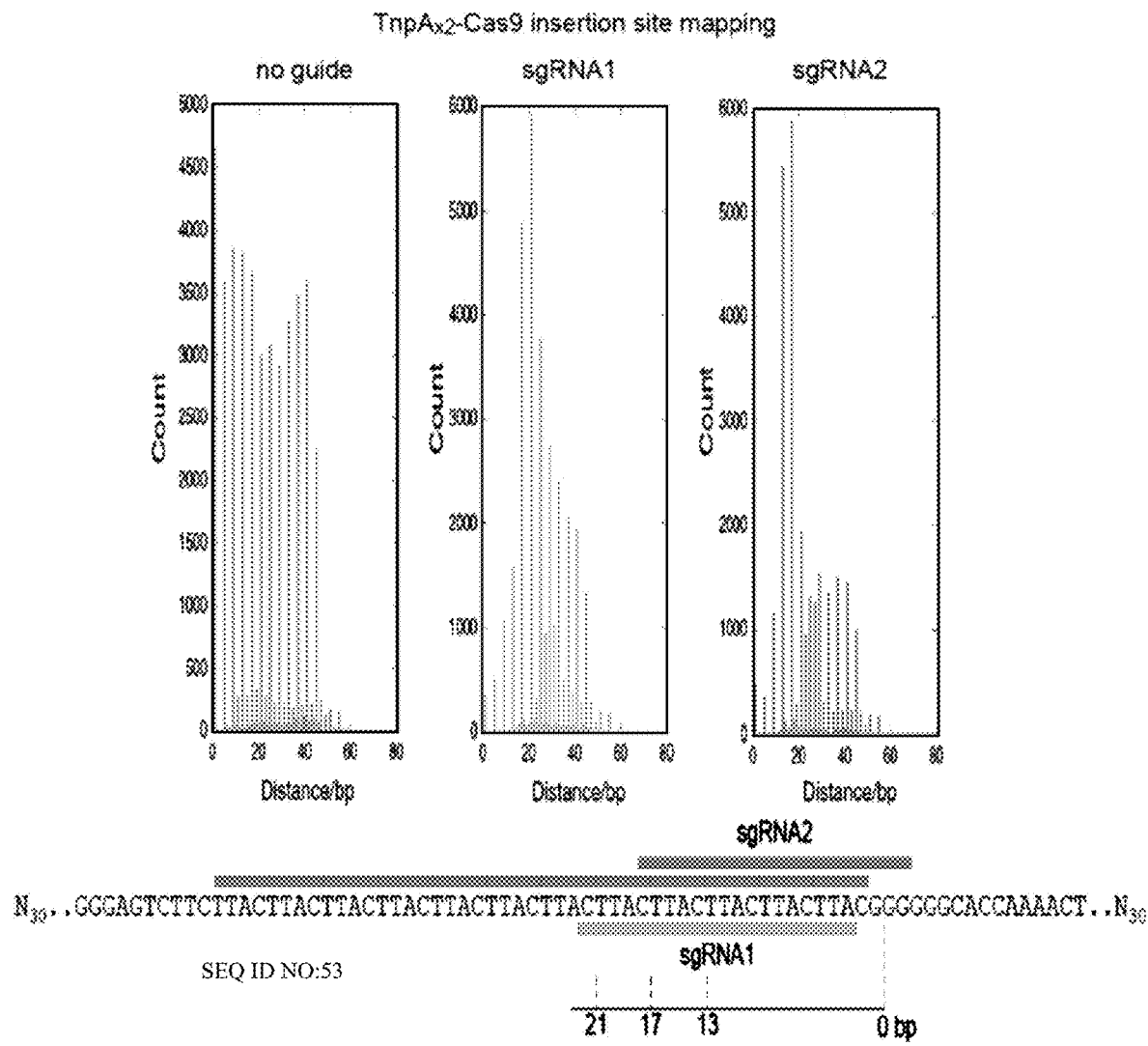
FIG. 35 shows NGS of the insertion sites from the highlighted E2 reactions in slide 7. In the absence of guide, insertions were detected at all possible positions in the array. Addition of sgRNA1 or sgRNA2 in the reaction biased insertion events to two more prominent sites in the substrate (SEQ ID NO:53).

FIG. 35 shows NGS of the insertion sites from the highlighted E2 reactions in slide 7. In the absence of guide, insertions were detected at all possible positions in the array. Addition of sgRNA1 or sgRNA2 in the reaction biased insertion events to two more prominent sites in the substrate.

Figure 36:
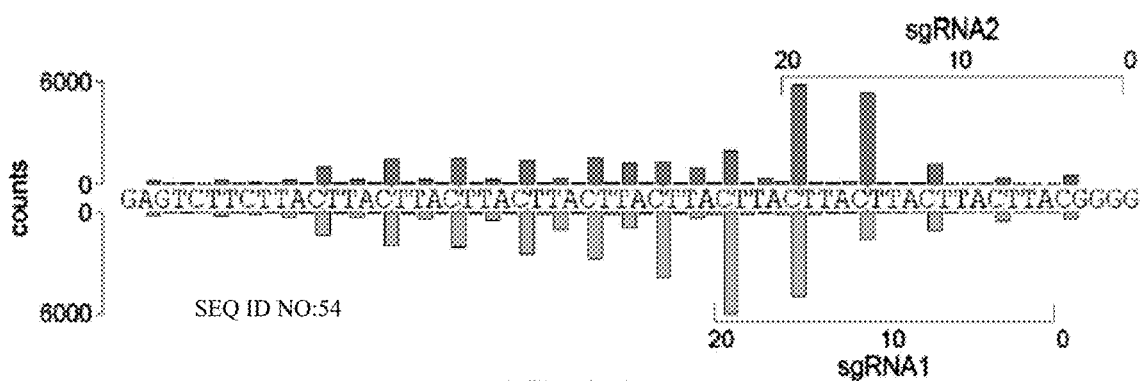
FIG. 36 shows the prominent insertions sites correspond to positions 16 and 20 from the PAM of the respective sgRNAs (SEQ ID NO:54).

FIG. 36 shows the prominent insertions sites correspond to positions 16 and 20 from the PAM of the respective sgRNAs. DNA insertions 3' to TTAC were at positions 16 and 20 in the sgRNA.

Figure 37:
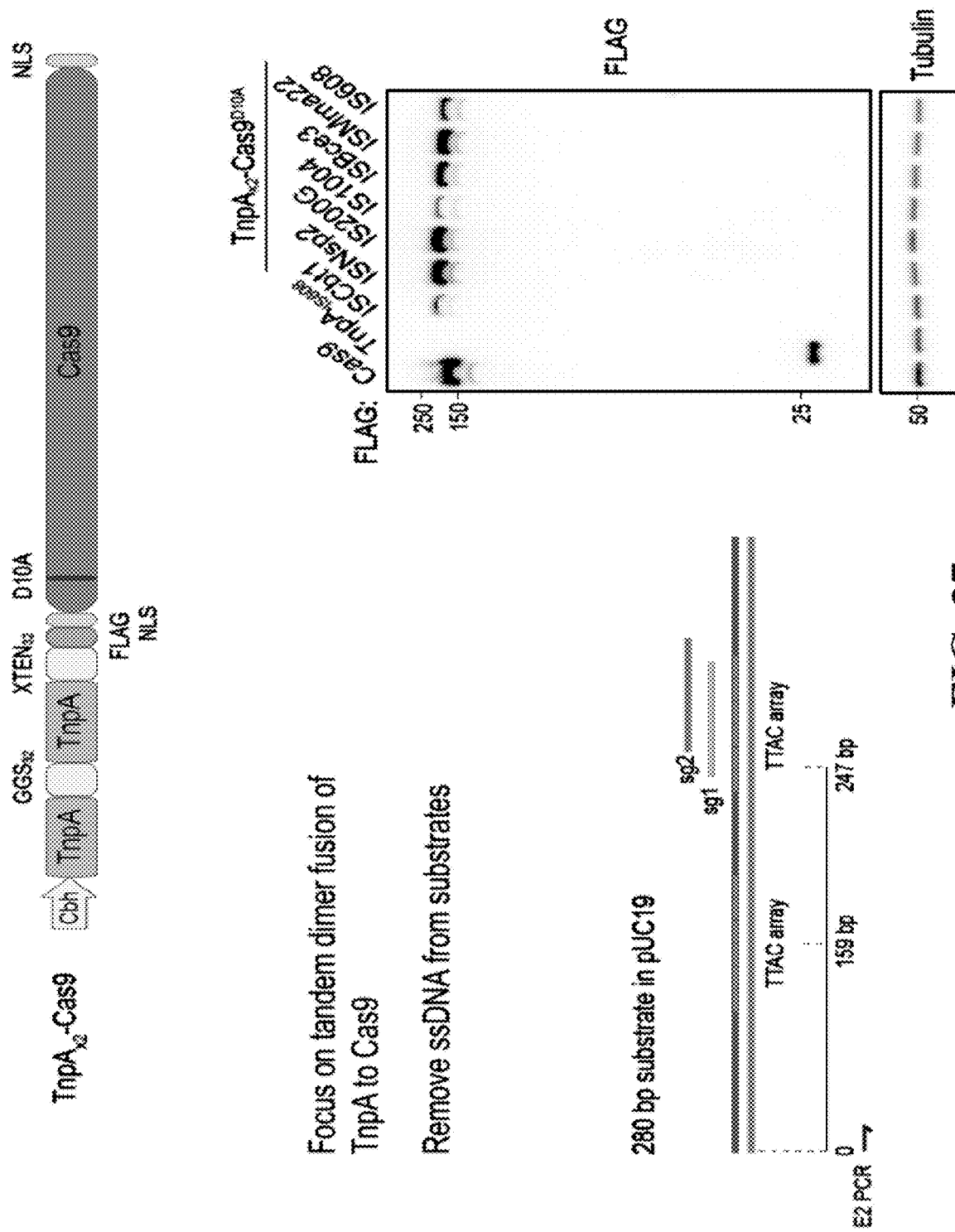

FIG. 37 shows a schematic and expression of new fusions of TnpA-Cas9 fusions from a variety of bacterial species. GGS32 and XTEN32 are polypeptide linkers. ISHp608 from *Helicobacter pylori*, ISCbt1 from *Clostridium botulinum*, ISNsp2 from *Nostoc* sp., ISBce3from *Bacillus cereus*, IS200G from *Yersinia pestis*, ISMma22 from *Methanosarcina mazei*, IS1004 from *Vibrio* chloerae. Experiments with Substrate 1 revealed insertion products with TnpA alone which may have resulted from single-stranded DNA contamination of the substrate. A second plasmid substrate (Substrate 2) was constructed with two arrays of six TTAC insertion sites. Single-stranded DNA was removed by T5 exonuclease digestion. This step focused on tandem dimer fusion of TnpA to Cas9. The ssDNA was removed from substrates.

FIG. 38 shows in vitro insertion reactions. Substrate 2 was incubated with the indicated mammalian cell lysates, a 160 bp circular single-stranded DNA donor, and sgRNA1. PCR E2 detects insertion events which are predicted to be 247 bp in size. The insertion product was dependent on Cas9, donor, and sgRNA.

FIG. 39 shows SDS-PAGE of TnpA-Cas9 purified protein (left, two dilutions shown). In vitro reactions with mammalian cell lysate and purified protein both reveal insertion events dependent on donor and sgRNA. $+^{lin}$ donor denotes a linear donor.

FIG. 40 shows NGS of the insertion sites from the highlighted reactions in slide 12. Low levels of insertion were detected throughout the array in the absence of guide. Addition of sgRNA2 resulted in targeted insertions within the guide sequence, most prominently at position 16 from the PAM. Cas9-targeted insertions 3' to TTAC were at position 16 in the sgRNA FIG. 41 shows a plasmid substrate (Substrate 3) with insertions sites recognized by different TnpA orthologs. In vitro reactions with mammalian lysates, a 160 bp circular single-stranded DNA donor, and sgRNAs. TnpA from IS608 inserts after TTAC sequence and targeting other regions of the substrate does not result in detectable insertions. A correct TnpA insertion site was needed within the sgRNA.

The Y1 HUH transposases were used for targeted insertions. Insertion events in dsDNA appeared dependent on Cas9, sgRNA and the presence of a TnpA insertion site.

Example 10—RNA-Guided DNA Insertion with CRISPR-Associated Transposases

CRISPR-Cas nucleases are powerful tools to manipulate nucleic acids, however, targeted insertion of DNA remains a challenge as it requires host cell repair machinery. Here Applicant characterized a CRISPR-associated transposase (CAST) from cyanobacteria *Scytonema hofmanni* which consists of Tn7-like transposase subunits and the type V-K CRISPR effector (Cas12k). ShCAST catalyzed RNA-guided DNA transposition by unidirectionally inserting segments of DNA 60-66 bp downstream of the protospacer. ShCAST integrated DNA into unique sites in the *E. coli* genome with frequencies of up to 80% without positive selection. This work expanded the understanding of the functional diversity of CRISPR-Cas systems and established a new paradigm for precision genome editing.

Prokaryotic Clustered Regularly Interspaced Short Palindromic Repeats (CRISPR) and CRISPR-associated proteins (Cas) systems provide adaptive immunity against foreign genetic elements via guide-RNA dependent DNA or RNA nuclease activity (1-3). CRISPR effectors, such as Cas9 and Cas12, have been harnessed for genome editing (4-8) and create targeted DNA double-strand breaks in the genome, which are then repaired using endogenous DNA damage repair pathways. Although it is possible to achieve precise integration of new DNA following Cas9 cleavage either through homologous recombination (9) or non-homologous end-joining (10, 11), these processes are inefficient and vary greatly depending on cell type. Homologous recombination repair is also tied to active cell division making it unsuitable for the vast number of post-mitotic cells that organisms contain. Recently, an alternative approach to make point mutations on DNA has been developed that relies on using dead Cas9 (12) to recruit cytidine or adenine deaminases to achieve base editing of genomic DNA (13-15). However, base editing is restricted to nucleotide substitutions, and thus efficient and targeted integration of DNA into the genome remains a major challenge.

To overcome these limitations, Applicant sought to leverage self-sufficient DNA insertion mechanisms, such as transposons. Bioengineering approaches of CRISPR-Cas effectors to facilitate DNA transposition were explored (FIGS. 47A-47F). Cas9 binding to DNA generated an R-loop structure and exposed a substrate for enzymes that act on single-stranded DNA (ssDNA). By tethering Cas9(D10A) to the ssDNA transposase TnpA from *Helicobacter pylori* IS608 (16, 17) Applicant observed targeted DNA insertions in vitro and in *E. coli* that were dependent on TnpA transposase activity, Cas9 sgRNA, and the presence of an insertion site within the ssDNA.

Recently, an association between Tn7-like transposons and subtype I-F, subtype I-B or subtype V-K (formerly, V-U5) CRISPR-Cas systems was reported (18, 19). All transposon-encoded CRISPR-Cas systems lack active nuclease domains; the type I loci encode a Cascade complex but no Cas3 helicase-nuclease, whereas the subtype V-K loci contain a Cas12k effector (formerly, C2c5) which contains mutations in the predicted active site of the RuvC-like nuclease (20), suggesting that these CRISPR-Cas systems can only bind but not cleave DNA. The CRISPR-Cas associated Tn7-like transposons contain tnsA, tnsB, tnsC, and tniQ genes (18), similar to the canonical Tn7 heterotrimeric TnsABC complex (21, 22). Tn7 is targeted to DNA via two alternative pathways that are mediated, respectively, by TnsD, a sequence-specific DNA binding protein which recognizes the Tn7 attachment site (23, 24), and TnsE, which facilitates transposition into conjugal plasmids and replicating DNA (25).

In the case of subtype V-K, the position of the CRISPR-Cas locus is strictly conserved in predicted transposons, suggesting that CRISPR-Cas is essential for transposition (19). Conversely, canonical Tn7 transposons often carry cargo genes that are beneficial to the host cell (22), in addition to the transposase machineries, raising the possibility that Cas12k may be yet another cargo gene. To date, no functional data on transposon-encoded CRISPR-Cas systems have been reported. Here, Applicant showed that Tn7-like transposons can be directed to target sites via crRNA-guided targeting and elucidate the molecular mechanism of crRNA-guided Tn7 transposition. Applicant further demonstrated that Tn7 transposition can be reprogrammed to insert DNA into the endogenous genome of *E. coli*, highlighting the potential of using RNA-guided Tn7-like transposons for genome editing.

Characterization of a Transposon Associated with a Type-V CRISPR System

Among the transposon-encoded CRISPR-Cas variants, the subtype V-K are the most attractive experimental systems because they contain a single protein CRISPR-Cas effector (18, 20, 26). Subtype V-K systems are so far limited to cyanobacteria and the latest non-redundant set includes 63 loci that, in the phylogenetic tree of Cas12k, split into 4 major branches, covering a broad taxonomic range of Cyanobacteria (19). All V-K systems are embedded within predicted Tn7-like transposable elements with no additional cas genes, suggesting that, if they are active CRISPR-Cas systems, they might rely on adaptation modules supplied in trans. Of the 560 analyzed V-K spacers, only 6 protospacer matches were identified: 3 from cyanobacterial plasmids, and 3 from single-stranded transposons of IS200 or IS650 families (19).

For experimental characterization, Applicant selected two Tn7-like transposons encoding subtype V-K CRISPR-Cas systems (hereafter, CAST, CRISPR-associated Transposase). The selected CAST loci were 20-25 kb in length and contained Tn7-like transposase genes at one end of the transposon with a CRISPR array and Cas12k on the other end, flanking internal cargo genes (FIG. 42A, FIGS. 48A, 48B). Applicant first cultured the native organisms *Scytonema hofmanni* (UTEX B 2349; FIG. 42B), and *Anabaena cylindrica* (PCC 7122) and performed small RNA-sequencing to determine if the CRISPR-Cas systems are expressed and active. For both loci, Applicant identified a long putative tracrRNA that mapped to the region between Cas12k and the CRISPR array, and in the case of *S. hofmanni* (ShCAST) Applicant detected crRNAs 28-34 nt long, consisting of 11-14 nt of direct repeat (DR) sequence with 17-20 nt of spacer (FIG. 42C, FIG. 48C).

To investigate whether ShCAST and AcCAST function as RNA-guided transposases, Applicant cloned the four CAST genes (tnsB, tnsC, tniQ, and Cas12k) into a helper plasmid (pHelper) along with the endogenous tracrRNA region and a crRNA targeting a synthetic protospacer (PSP1). Applicant predicted ends of the transposons by searching for TGTACA-like terminal repeats surrounded by a duplicated insertion site (18) and constructed donor plasmids (pDonor) containing the kanamycin resistance gene flanked by the transposon left end (LE) and right end (RE). Given that CRISPR-Cas effectors require a protospacer adjacent motif (PAM) to recognize target DNA (27), Applicant generated a target plasmid (pTarget) library containing the PSP1 sequence flanked by a 6N motif upstream of the protospacer. Applicant co-electroporated pHelper, pDonor, and pTarget into *E. coli* and extracted plasmid DNA after 16 h (FIG. 42D). Applicant detected insertions into the target plasmid by PCR for both ShCAST and AcCAST and deep sequencing confirmed the insertion of the LE into pTarget. Analysis of PAM sequences in pInsert plasmids revealed a preference for GTN PAMs for both ShCAST and AcCAST systems, suggesting that these insertions result from Cas12k targeting (FIG. 42E, FIGS. 49A, 49B). Applicant next examined the position of the donor in pInsert products relative to the protospacer. Insertions were detected within a small window 60-66 bp downstream from the PAM for ShCAST and 49-56 bp from the PAM for AcCAST (FIG. 42F). No insertions were detected in the opposite orientation for either system, indicating that CAST functions unidirectionally. Although DNA insertions could potentially arise from genetic recombination in *E. coli*, the discovery of an associated PAM sequence and the constrained position of insertions argues against this possibility.

To validate these findings, Applicant transformed *E. coli* with ShCAST pHelper and pDonor plasmids along with target plasmids containing a GGTT PAM, an AACC PAM, and a scrambled non-target sequence. Applicant assessed insertion events by quantitative droplet digital PCR (ddPCR), which revealed insertions of the donor only in the presence of pHelper and a pTarget containing a GGTT PAM and crRNA-matching protospacer sequence (FIG. 42G). Additional experiments with 16 PAM sequences confirmed a preference for NGTN motifs (FIG. 49C). As further validation, Applicant recovered pInsert products and performed Sanger sequencing of both LE and RE junctions. All sequenced insertions were located 60-66 bp from the PAM and contained a 5-bp duplicated insertion motif flanking the inserted DNA (FIG. 50), consistent with the staggered DNA breaks generated by Tn7 (28). As Tn7 inserts into a CCCGC motif downstream of its attachment site, Applicant hypothesized that the sequence within the insertion window might also be important for CAST function. Applicant generated a second target library with an 8N motif located 55 bp from the PAM and again co-transformed the library into *E. coli* with ShCAST pHelper and pDonor followed by deep sequencing (FIG. 51A). Applicant observed only a minor sequence preference upstream of the LE in pInsert, with a slight T/A preference 3 bases upstream of the insertion site (FIGS. 51B-51D). ShCAST can therefore target a wide range of DNA sequences with minimal targeting rules. Together these results indicate that AcCAST and ShCAST catalyze DNA insertion in a heterologous host and that these insertions are dependent on a targeting protospacer and a distinct PAM sequence.

Genetic Requirements for RNA-Guided Insertions

Applicant next sought to determine the genetic requirements for ShCAST insertions in *E. coli* and, to that end, constructed a series of pHelper plasmids with deletions of each element. Insertions into pTarget required all four CAST proteins and the tracrRNA region (FIG. 43A). To better characterize the tracrRNA sequence, Applicant complemented pHelperΔtracrRNA with various tracrRNA driven by the pJ23119 promoter. Expression of the 216-nt tracrRNA variant 6 was alone sufficient to restore DNA transposition (FIG. 43B). The 3' end of the tracrRNA is predicted to hybridize with a crRNA containing 14 nt of the DR sequence and Applicant designed single guide RNAs (sgRNA) testing two linkers between the tracrRNA and crRNA sequences. Both designs supported insertion activity in the context of the tracrRNA variant 6 (FIG. 43C). Applicant observed that expression of tracrRNA or sgRNA with the pJ23119 promoter resulted in a 5-fold increase in the insertion activity compared to the natural locus, suggesting that RNA was rate-limiting during heterologous expression.

As ShCAST does not destroy the protospacer upon DNA insertion, Applicant asked whether multiple insertions could occur in pTarget, or if these are inhibited as with canonical Tn7 (29, 30). Applicant generated target plasmids containing LE+RE, or LE alone, and measured ShCAST transposition activity at 6 nearby protospacers. Applicant observed a strong inhibitory effect on transposition at a protospacer 62 bp from the LE (less than 1% of relative activity to pTarget), and only 5.7% relative activity 542 bp from the LE (FIG. 43D), indicating that CAST transposon ends act in cis to prevent multiple insertions. The presence of LE alone resulted in a weaker inhibitory effect and Applicant observed 61.1% of activity at 542 bp away from the transposon end (FIGS. 52A, 52B).

The original pDonor contained 2.2 kb of cargo DNA, and Applicant next tested the effect of donor length on ShCAST activity ranging from 500 bp to 10 kb. Applicant observed a 2-fold higher insertion rate with a 500 bp donor, and a similar rate of insertions with 10 kb of payload compared to the original pDonor (FIG. 52C). Applicant were unable to detect re-joined pDonor backbone during transposition in E. coli (FIGS. 52D, 52E), suggesting that a linear donor backbone is formed, and not a rejoined product, consistent with the known reaction products of canonical Tn7 (28, 31). Finally, Applicant investigated the requirement of the LE and RE transposon ends sequences contained in pDonor for transposition. Removal of all flanking genomic sequence or the 5 bp duplicated target sites had little effect on insertion frequency, and ShCAST tolerated truncations of LE and RE to 113 bp and 155 bp, respectively (FIG. 53A). Removal of additional donor sequence completely abolished transposase activity, consistent with the loss of predicted Tn7 TnsB-like binding motifs (FIGS. 53B, 53C).

In Vitro Reconstitution of ShCAST

Although the data strongly suggested that ShCAST mediates RNA-guided DNA insertion, to exclude the requirement of additional host factors, Applicant next sought to reconstitute the reaction in vitro. Applicant purified all four ShCAST proteins (FIG. 54A) and performed in vitro reactions using pDonor, pTarget, and purified RNA (FIG. 44A). Addition of all four protein components, crRNA, and tracrRNA resulted in DNA insertions detected by both LE and RE junction PCRs, as did reactions containing the four protein components and sgRNA (FIG. 44B). The truncated tracrRNA variant 5 was also able to support DNA-insertion in vitro, in contrast with the activity observed in E. coli. ShCAST-catalyzed transposition in vitro occurred between 37-50° C. and depended on ATP and $Mg^{2+}$ (FIGS. 54B, 54C). To confirm that in vitro insertions are in fact targeted, Applicant performed reactions with target plasmids containing a GGTT PAM, an AACC PAM, and a scrambled non-target sequence, and could only detect DNA insertions into the GGTT PAM substrate with the target sequence (FIG. 44C). In vitro DNA transposition depended on all four CAST proteins, although Applicant identified weak but detectable insertions in the absence of tniQ (FIG. 44D).

Consistent with the predicted lack of nuclease activity of Cas12k, Applicant were unable to detect DNA cleavage in the presence of Cas12k and sgRNA across a range of buffer conditions (FIG. 54D). To determine whether other CRISPR-Cas effectors could also stimulate DNA transposition, Applicant performed reactions with tnsB, tnsC, and tniQ, along with dCas9 and a sgRNA targeting the same GGTT PAM substrate. Applicant were unable to detect any insertions following dCas9 incubation (FIG. 44E), indicating that the function of Cas12k is not merely DNA binding, and that DNA transposition by CAST does not simply occur at R-loop structures. As final validation, Applicant transformed in vitro reaction products into E. coli and performed Sanger sequencing to determine the LE and RE junctions. All sequenced donors were located in pTarget, 60-66 bp from the PAM, and containing duplicated 5-bp insertion sites, demonstrating complete reconstitution of ShCAST with purified components.

ShCAST Mediates Efficient and Precise Genome Insertions in E. coli

To test whether ShCAST could be reprogrammed as a DNA insertion tool, Applicant selected 48 targets in the E. coli genome and co-transformed pDonor and pHelper plasmids expressing targeting sgRNAs (FIG. 45A). Applicant detected insertions by PCR at 29 out of the 48 sites (60.4%) and selected 10 sites for additional validation (FIG. 55A). Applicant performed ddPCR to quantitate insertion frequency after 16 h and measured rates up to 80% at PSP42 and PSP49 (FIG. 45B). This high efficiency of insertion was surprising given that insertion events were not selected for by antibiotic resistance, so Applicant performed PCR of target sites to confirm. Strikingly, Applicant detected the 2.5 kb insertion product in the transformed population (FIG. 45C). Re-streaking transformed E. coli yielded pure single colonies, the majority of which contained the targeted insertion (FIG. 55B) and the high efficiency of integration was maintained with a variety of donor DNA lengths (FIG. 55C). Applicant analyzed the position of genome insertions by targeted deep sequencing of the LE and RE junctions and observed insertions within the 60-66 bp window at all 10 sites (FIG. 45D, FIG. 56A).

Applicant next assayed the specificity of RNA-guided DNA transposition. Applicant performed unbiased sequencing of donor insertion sites following Tn5 tagmentation of gDNA. Applicant observed one prominent insertion site in each sample, which mapped to the target site, and contained more than 50% of the total insertion reads (FIG. 45E). The remaining off-target reads were scattered across the genome and analysis of the top off-target sites revealed strong overlap between samples revealing that these events are independent of the guide sequence (FIG. 56B, Table 24). Top off-target sites were located near ribosomal genes, serine-tRNA ligase, and enolase, among others, although insertion frequency in these regions were all less than 1% of the on-target site (Table 24). Applicant identified one potential RNA-guided off-target following targeting of PSP42 which contains 4 mismatches to the guide sequence (FIG. 56C). Together, these results indicate that ShCAST robustly and precisely inserts DNA into the target site.

DISCUSSION

Here Applicant characterized a CRISPR-Cas system associated with a Tn7-like transposon and provided evidence of RNA-guided DNA transposition in E. coli and in vitro. ShCAST mediated efficient and precise unidirectional insertions in a narrow window downstream of the target and inhibits multiple insertions into a single target (FIG. 46). Although ShCAST and AcCAST exhibit similar PAM preference, one notable difference was that their respective positions of insertion relative to the PAM, differ by 10-11 bp, which roughly corresponds to one turn of DNA.

Targeted DNA insertion by ShCAST resulted in the incorporation of LE and RE elements and was therefore not a scarless integration method. One generalizable strategy for the use of CAST in the therapeutic context is to insert corrected exons into the intron before the mutated exon (FIG. 57). CAST may also be used to insert transgenes into "safe harbor" loci (32) or downstream of endogenous promoters so that the expression of transgenes of interest can benefit from endogenous gene regulation.

Applicant observed that TniQ is required for RNA-guided insertions in *E. coli*. The observation that in vitro transposition can occur to a limited extent in the absence of TniQ is compatible with a model in which TniQ facilitates the formation of the CAST complex and is not essential for catalytic function, therefore, it might be possible to engineer simplified versions of CAST systems without TniQ or with fragments of TniQ.

The analysis indicates that ShCAST was fairly specific, but can integrate at non-targeted sites in the *E. coli* genome via Cas12k-independent mechanisms, and this guide-independent integration seems to favor highly expressed genes. Applicant also observed non-targeted insertions into pHelper in *E. coli* which was independent of Cas12k (FIG. 58) and reminiscent of TnsE-mediated Tn7 insertions into conjugal plasmids and replicating DNA (25).

In summary, this work identified a new function for CRISPR-Cas systems that did not require Cas nuclease activity and provides a strategy for targeted insertion of DNA without engaging homologous recombination pathways, with a particularly exciting potential for genome editing in eukaryotic cells.

EXAMPLE —SPECIFIC REFERENCES

1. R. Barrangou, P. Horvath, A decade of discovery: CRISPR functions and applications. Nat Microbiol 2, 17092 (2017).
2. P. Mohanraju et al., Diverse evolutionary roots and mechanistic variations of the CRISPR-Cas systems. Science 353, aad5147 (2016).
3. L. A. Marraffini, CRISPR-Cas immunity in prokaryotes. Nature 526, 55-61 (2015).
4. L. Cong et al., Multiplex Genome Engineering Using CRISPR/Cas systems. Science 339, 819-823 (2013).
5. P. Mali et al., RNA-Guided Human Genome Engineering via Cas9. Science 339, 823-826 (2013).
6. B. Zetsche et al., Cpf1 is a single RNA-guided endonuclease of a class 2 CRISPR-Cas system. Cell 163, 759-771 (2015).
7. J. Strecker et al., Engineering of CRISPR-Cas12b for human genome editing. Nat Commun 10, 212 (2019).
8. F. Teng et al., Repurposing CRISPR-Cas12b for mammalian genome engineering. Cell discovery 4, 63 (2018).
9. M. Jasin, R. Rothstein, Repair of strand breaks by homologous recombination. Cold Spring Harb Perspect Biol 5, a012740 (2013).
10. J. L. Schmid-Burgk, K. Honing, T. S. Ebert, V. Hornung, CRISPaint allows modular base-specific gene tagging using a ligase-4-dependent mechanism. Nat Commun 7, 12338 (2016).
11. K. Suzuki et al., In vivo genome editing via CRISPR/Cas9 mediated homology-independent targeted integration. Nature 540, 144-149 (2016).
12. L. S. Qi et al., Repurposing CRISPR as an RNA-Guided Platform for Sequence-Specific Control of Gene Expression. Cell 152, 1173-1183 (2013).
13. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
14. N. M. Gaudelli et al., Programmable base editing of A*T to G*C in genomic DNA without DNA cleavage. Nature 551, 464-471 (2017).
15. K. Nishida et al., Targeted nucleotide editing using hybrid prokaryotic and vertebrate adaptive immune systems. Science 353, aaf8729-aaf8729 (2016).
16. C. Guynet et al., In vitro reconstitution of a single-stranded transposition mechanism of IS608. Mol Cell 29, 302-312 (2008).
17. O. Barabas et al., Mechanism of IS200/IS605 family DNA transposases: activation and transposon-directed target site selection. Cell 132, 208-220 (2008).
18. J. E. Peters, K. S. Makarova, S. Shmakov, E. V. Koonin, Recruitment of CRISPR-Cas systems by Tn7-like transposons. P Natl Acad Sci USA 114, E7358-E7366 (2017).
19. G. Faure et al., CRISPR-Cas in mobile genetic elements: counter-defense and beyond. Nat Rev Microbiol in press, (2019).
20. S. Shmakov et al., Diversity and evolution of class 2 CRISPR-Cas systems. Nat Rev Microbiol 15, 169-182 (2017).
21. R. J. Sarnovsky, E. W. May, N. L. Craig, The Tn7 transposase is a heteromeric complex in which DNA breakage and joining activities are distributed between different gene products. EMBO J 15, 6348-6361 (1996).
22. J. E. Peters, N. L. Craig, Tn7: smarter than we thought. Nat Rev Mol Cell Biol 2, 806-814 (2001).
23. C. S. Waddell, N. L. Craig, Tn7 transposition: recognition of the attTn7 target sequence. Proc Natl Acad Sci USA 86, 3958-3962 (1989).
24. C. S. Waddell, N. L. Craig, Tn7 transposition: two transposition pathways directed by five Tn7-encoded genes. Genes Dev 2, 137-149 (1988).
25. J. E. Peters, N. L. Craig, Tn7 recognizes transposition target structures associated with DNA replication using the DNA-binding protein TnsE. Genes Dev 15, 737-747 (2001).
26. S. Hou et al., CRISPR-Cas systems in multicellular cyanobacteria. RNA Biol 16, 518-529 (2019).
27. F. J. Mojica, C. Diez-Villasenor, J. Garcia-Martinez, C. Almendros, Short motif sequences determine the targets of the prokaryotic CRISPR defence system. Microbiology 155, 733-740 (2009).
28. R. Bainton, P. Gamas, N. L. Craig, Tn7 transposition in vitro proceeds through an excised transposon intermediate generated by staggered breaks in DNA. Cell 65, 805-816 (1991).
29. Z. Skelding, J. Queen-Baker, N. L. Craig, Alternative interactions between the Tn7 transposase and the Tn7 target DNA binding protein regulate target immunity and transposition. EMBO J 22, 5904-5917 (2003).
30. A. E. Stellwagen, N. L. Craig, Avoiding self: two Tn7-encoded proteins mediate target immunity in Tn7 transposition. EMBO J 16, 6823-6834 (1997).
31. M. C. Biery, F. J. Stewart, A. E. Stellwagen, E. A. Raleigh, N. L. Craig, A simple in vitro Tn7-based transposition system with low target site selectivity for genome and gene analysis. Nucleic Acids Res 28, 1067-1077 (2000).
32. M. Sadelain, E. P. Papapetrou, F. D. Bushman, Safe harbours for the integration of new DNA in the human genome. Nat Rev Cancer 12, 51-58 (2011).

Data Availability: Expression plasmids are available from Addgene under UBMTA; support forums and computational tools are available via the Zhang lab website (zlab.bio/).

Materials and Methods

Cyanobacteria RNA Sequencing

*Scytonema hofmanni* (UTEX B 2349) and *Anabaena cylindrica* (PCC 7122) were cultured in BG-11 media (ThermoFisher) at 25° C. with light periodicity of 14 hours on, 10 hours off. RNA was isolated using the miRNeasy Mini Kit (Qiagen) and treated with DNase I (NEB). rRNA was removed using RiboMinus (ThermoFisher). RNA libraries were prepared from rRNA-depleted RNA using NEBNext Small RNA Library Prep Set for Illumina (NEB).

RNA-Sequencing Analysis

RNA libraries were sequenced using a NextSeq 500/550 High Output Kit v2, 75 cycles (Illumina). Paired-end reads were aligned to their respective reference genomes using BWA (33) and entire transcripts were extracted using BED-Tools. Resulting transcript sequences were analyzed using Geneious Prime 2019.0.4.

Generation of Heterologous Plasmids

Purified gDNA from *Scytonema hofmanni* and *Anabaena cylindrica* were prepped using the DNeasy Blood and Tissue Kit (Qiagen). Subsequently, CAST loci, excluding cargo genes, were amplified from the purified gDNA using KAPA HiFi HotStart ReadyMix (Kapa Biosystems) and cloned into pUC19. A lac promoter was placed in front of the CAST transposase genes and Cas12k gene, and a J23119 promoter was added in front of a shortened CRISPR array with two direct repeats. The first endogenous spacer in the array was replaced with the FnCpf1 protospacer 1 (PSP1) sequence (5'-GAGAAGTCATTTAATAAGGCCACTGTTAAAA-3' (SEQ ID NO:639)). The CAST open reading frames (ORFs) and downstream tracr regions were unchanged. Sequences of all bacterial expression plasmids can be found in Table 21.

PAM and Motif Screens

A randomized target PAM and insertion motif library was generated using synthesized ssDNA oligonucleotides (IDT) with 6 randomized bases upstream of PSP1 and 8 randomized bases starting 55 bp downstream of the spacer. Oligonucleotides were used to generate a PCR product for subsequent Gibson assembly (NEB) into pACYC184 vectors. Gibson products were electroporated into Endura Electro-Competent cells (Lucigen), recovered for 1 hour, and plated on chloramphenicol plates. Cells were harvested 16 hours after plating and plasmid DNA was harvested using a Maxi-prep kit (Macherey-Nagel). 100 ng of library target DNA was co-electroporated with 100 ng of both pHelper and pDonor into TransforMax EC100D pir+ *E. coli*. Cells were recovered for 1 hour and plated on ampicillin, kanamycin, and chloramphenicol-containing plates. Insertion products containing the randomized PAM sequence or motif sequence were amplified and sequenced using a MiSeq Reagent Kit v2, 300-cycle (Illumina). In addition, the PAM and motif sequences in the library targets were amplified and sequenced alongside insertion samples.

PAM and Motif Discovery Pipeline

For sequence verified insertion events, the randomized PAM region and motif regions were extracted, counted, and normalized to the total number of reads from the corresponding sample. The enrichment of a given randomized sequence was determined by its ratio in the insertion sample to its abundance in the library target. These ratios were used to create PAM wheels using Kronos Plot (github.com/marbl/Krona/wiki) (34). PAMs and motifs above a log 2 enrichment threshold of 4 and 1, respectively, were collected and used to generate sequence logos.

Droplet Digital PCR (ddPCR)

ddPCR Supermix for Probes (BioRad), primers, product specific probes, and sample were combined into 20 uL reactions and droplets were generated using the QX200 Droplet Generator (BioRad). Insertion events were quantified using insertion PCR specific primers and a donor specific probe (Table 23). Targets were quantified using target specific PCR primers and a corresponding probe (Table 23). Thermal cycling conditions for ddPCR reactions were as follows: 1 cycle, 95° C., 10 min; 40 cycles, 94° C., 30 sec, 60° C., 1 min; 1 cycle, 98° C., 10 mins; 4° C. hold; 2° C./sec ramp for every step. ddPCR plates were sealed with a foil heat seal (BioRad) and read with a QX200 Droplet Reader. Absolute concentrations of inserts and targets were determined using QuantaSoft (v1.6.6.0320) and insertion frequency calculated by inserts/(inserts+targets).

*E. coli* Plasmid-Targeting Assays

Targeted transposition into target plasmids was performed by transformation of 5 ng each of pHelper, pInsert, and pTarget into One Shot Pir1 Chemically Competent *E. coli* (Invitrogen). Cells were recovered for 1 hour and plated on ampicillin, kanamycin, and chloramphenicol-containing plates. Cells were harvested 16 hours after plating and grown for 8 hours in LB media containing ampicillin, kanamycin, and chloramphenicol. Plasmid DNA was isolated using a Qiaprep Miniprep Kit (Qiagen), diluted approximately 500-fold, and quantified using ddPCR as described above.

Purification of shCAST Proteins

ShCAST genes were cloned into bacterial expression plasmids (T7-TwinStrep-SUMO-NLS-Cas12b-NLS-3×HA) and expressed in BL21(DE3) cells (NEB #C2527H) containing a pLysS-tRNA plasmid (from Novagen #70956). Cells were grown in Terrific Broth to mid-log phase and the temperature lowered to 20° C. Expression was induced at 0.6 OD with 0.25 mM IPTG for 16-20 h before harvesting and freezing cells at −80° C. Cell paste was resuspended in lysis buffer (50 mM TRIS pH 7.4, 500 mM NaCl, 5% glycerol, 1 mM DTT) supplemented with EDTA-free cOmplete protease inhibitor (Roche). Cells were lysed using a LM20 microfluidizer device (Microfluidics) and cleared lysate was bound to Strep-Tactin Superflow Plus resin (Qiagen). Resin was washed using lysis buffer and protein was eluted with lysis buffer supplemented with 5 mM desthiobiotin, with the exception of tniQ. The TwinStrep-SUMO tag was removed by overnight digest at 4° C. with homemade SUMO protease Ulp1 at a 1:100 weight ratio of protease to target. tniB, tniC, and Cas12k protein was diluted with 50 mM TRIS pH 7.4, 50 mM NaCl to a final concentration of 200 mM NaCl and purified using a HiTrap Heparin HP column on an AKTA Pure 25 L (GE Healthcare Life Sciences) with a 200 mM-1M NaCl gradient. Fractions containing protein were pooled and concentrated and loaded onto a Superdex 200 Increase column (GE Healthcare Life Sciences) with a final storage buffer of 25 mM TRIS pH 7.4, 500 mM NaCl, 0.5 mM EDTA, 10% glycerol, 1 mM DTT. tniQ was cleaved from Strep-Tactin Superflow Plus resin with SUMO protease Ulp1 overnight at 4° C. and loaded onto a Superdex 200 Increase column with a final storage buffer of 25 mM TRIS pH 7.4, 500 mM NaCl, 0.5 mM EDTA, 10% glycerol, 1 mM DTT. All proteins were concentrated to 1 mg/mL stocks and flash-frozen in liquid nitrogen before storage at −80° C.

In Vitro Transposition Assays

Purified proteins were diluted to 2 uM in 25 mM Tris pH 8, 500 mM NaCl, 1 mM EDTA, 1 mM DTT, 25% glycerol. All RNA was generated by annealing a DNA oligonucleotide containing the reverse complement of the desired RNA with a short T7 oligonucleotide or by adding the T7 promoter through PCR. In vitro transcription was performed using the HiScribe T7 High Yield RNA synthesis kit (NEB) at 37° C. for 8-12 hours and RNA was purified using Agencourt AMPure RNA Clean beads (Beckman Coulter).

In vitro transposition reactions were carried out with 50 nM of each protein where indicated, 20 ng of pTarget plasmid, 100 ng of pDonor, 600 nM final RNA concentration in a final reaction buffer of 26 mM HEPES pH 7.5, 4.2 mM TRIS pH 8, 50 ug/mL BSA, 2 mM ATP, 2.1 mM DTT, 0.05 mM EDTA, 0.2 mM MgCl2, 28 mM NaCl, 21 mM KCl, 1.35% glycerol, (final pH 7.5) supplemented with 15 mM MgOAc2 as previously described for Tn7(35). Total reaction volumes were 20 uL and reactions were incubated for 2 hours at the indicated temperature and purified using Qiagen PCR Purification columns before bacterial transformation or PCR readout.

E. coli Genome-Targeting Assays 48 guides with NGTN PAMs were randomly chosen in non-coding regions of the E. coli genome (Table 22) and cloned into pHelper with the sgRNA configuration. 5 ng of pHelper constructs targeting the genome were transformed into PirI cells harboring pDonor, recovered for 15 minutes, and plated on ampicillin and kanamycin-containing plates. Successful insertion was identified by performing nested colony PCR using KAPA HiFi HotStart ReadyMix (Kapa Biosystems). The remainder of cells were harvested 16 hours after plating and gDNA was purified using DNeasy Blood and Tissue Kit (Qiagen) for further analysis.

Genome insertions were sequence verified by insertion-specific amplification and sequenced using a MiSeq Reagent Kit v2, 150-cycle (Illumina). Paired end reads were trimmed of donor sequence and mapped to the genome using BWA (33). Resulting sequences were used to determine insertion position relative to the guide sequence. Frequency of genome insertions was determined with ddPCR as described above with a guide specific forward primer (Table 20). Target abundance was determined by ddPCR amplification of the target sequence using guide specific primers (Table 22) and QX200 ddPCR EvaGreen Supermix (Bio-Rad).

E. coli Specificity Analysis 100 ng of pHelper with sgRNA targeting PSP15, PSP42, or PSP49 was electroporated alongside 100 ng of a modified pDonor harboring a temperature sensitive pSC101 origin into Endura ElectroCompetent cells. After 1 hour of recovery, cells were grown for 6 hours in LB media containing ampicillin and kanamycin at 30° C. Recovered cells were plated on media containing ampicillin and grown for 12 hours at 43° C. gDNA was purified using DNeasy Blood and Tissue Kit. Unbiased detection of transposition events was performed as previously described (7). Purified gDNA was tagmented with Tn5, followed by QIAquick PCR purification (Qiagen). Tagmented DNA samples were amplified using two rounds of PCR with KOD Hot Start DNA Polymerase (Millipore) using a Tn5 adapter-specific primer and nested primers within the DNA donor. The resulting libraries were sequenced using a NextSeq v2 kit, 75 cycle. Paired end reads were filtered to remove sequences not matching donor sequence, either due to low quality or amplification artefacts. Remaining reads were trimmed of donor sequence and mapped to the genome using BWA (33) to determine insertion position. Insertion positions with more than two unique reads were called as genome insertions for subsequent analysis. On-target rate was defined as the number of reads mapping to the region 55-75 bp downstream of the targeting protospacer compared to all reads mapping to genome insertions.

EXAMPLE SPECIFIC REFERENCES

1. R. Barrangou, P. Horvath, A decade of discovery: CRISPR functions and applications. Nat Microbiol 2, 17092 (2017).
2. P. Mohanraju et al., Diverse evolutionary roots and mechanistic variations of the CRISPR-Cas systems. Science 353, aad5147 (2016).
3. L. A. Marraffini, CRISPR-Cas immunity in prokaryotes. Nature 526, 55-61 (2015).
4. L. Cong et al., Multiplex Genome Engineering Using CRISPR/Cas systems. Science 339, 819-823 (2013).
5. P. Mali et al., RNA-Guided Human Genome Engineering via Cas9. Science 339, 823-826 (2013).
6. B. Zetsche et al., Cpf1 is a single RNA-guided endonuclease of a class 2 CRISPR-Cas system. Cell 163, 759-771 (2015).
7. J. Strecker et al., Engineering of CRISPR-Cas12b for human genome editing. Nat Commun 10, 212 (2019).
8. F. Teng et al., Repurposing CRISPR-Cas12b for mammalian genome engineering. Cell discovery 4, 63 (2018).
9. M. Jasin, R. Rothstein, Repair of strand breaks by homologous recombination. Cold Spring Harb Perspect Biol 5, a012740 (2013).
10. J. L. Schmid-Burgk, K. Honing, T. S. Ebert, V. Hornung, CRISPaint allows modular base-specific gene tagging using a ligase-4-dependent mechanism. Nat Commun 7, 12338 (2016).
11. K. Suzuki et al., In vivo genome editing via CRISPR/Cas9 mediated homology-independent targeted integration. Nature 540, 144-149 (2016).
12. L. S. Qi et al., Repurposing CRISPR as an RNA-Guided Platform for Sequence-Specific Control of Gene Expression. Cell 152, 1173-1183 (2013).
13. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
14. N. M. Gaudelli et al., Programmable base editing of A*T to G*C in genomic DNA without DNA cleavage. Nature 551, 464-471 (2017).
15. K. Nishida et al., Targeted nucleotide editing using hybrid prokaryotic and vertebrate adaptive immune systems. Science 353, aaf8729-aaf8729 (2016).
16. C. Guynet et al., In vitro reconstitution of a single-stranded transposition mechanism of IS608. Mol Cell 29, 302-312 (2008).
17. O. Barabas et al., Mechanism of IS200/IS605 family DNA transposases: activation and transposon-directed target site selection. Cell 132, 208-220 (2008).
18. J. E. Peters, K. S. Makarova, S. Shmakov, E. V. Koonin, Recruitment of CRISPR-Cas systems by Tn7-like transposons. P Natl Acad Sci USA 114, E7358-E7366 (2017).
19. G. Faure et al., CRISPR-Cas in mobile genetic elements: counter-defense and beyond. Nat Rev Microbiol in press, (2019).
20. S. Shmakov et al., Diversity and evolution of class 2 CRISPR-Cas systems. Nat Rev Microbiol 15, 169-182 (2017).
21. R. J. Sarnovsky, E. W. May, N. L. Craig, The Tn7 transposase is a heteromeric complex in which DNA breakage and joining activities are distributed between different gene products. EMBO J 15, 6348-6361 (1996).

22. J. E. Peters, N. L. Craig, Tn7: smarter than we thought. Nat Rev Mol Cell Biol 2, 806-814 (2001).
23. C. S. Waddell, N. L. Craig, Tn7 transposition: recognition of the attTn7 target sequence. Proc Natl Acad Sci USA 86, 3958-3962 (1989).
24. C. S. Waddell, N. L. Craig, Tn7 transposition: two transposition pathways directed by five Tn7-encoded genes. Genes Dev 2, 137-149 (1988).
25. J. E. Peters, N. L. Craig, Tn7 recognizes transposition target structures associated with DNA replication using the DNA-binding protein TnsE. Genes Dev 15, 737-747 (2001).
26. S. Hou et al., CRISPR-Cas systems in multicellular cyanobacteria. RNA Biol 16, 518-529 (2019).
27. F. J. Mojica, C. Diez-Villasenor, J. Garcia-Martinez, C. Almendros, Short motif sequences determine the targets of the prokaryotic CRISPR defence system. Microbiology 155, 733-740 (2009).
28. R. Bainton, P. Gamas, N. L. Craig, Tn7 transposition in vitro proceeds through an excised transposon intermediate generated by staggered breaks in DNA. Cell 65, 805-816 (1991).
29. Z. Skelding, J. Queen-Baker, N. L. Craig, Alternative interactions between the Tn7 transposase and the Tn7 target DNA binding protein regulate target immunity and transposition. EMBO J 22, 5904-5917 (2003).
30. A. E. Stellwagen, N. L. Craig, Avoiding self: two Tn7-encoded proteins mediate target immunity in Tn7 transposition. EMBO J 16, 6823-6834 (1997).
31. M. C. Biery, F. J. Stewart, A. E. Stellwagen, E. A. Raleigh, N. L. Craig, A simple in vitro Tn7-based transposition system with low target site selectivity for genome and gene analysis. Nucleic Acids Res 28, 1067-1077 (2000).
32. M. Sadelain, E. P. Papapetrou, F. D. Bushman, Safe harbours for the integration of new DNA in the human genome. Nat Rev Cancer 12, 51-58 (2011).
33. H. Li, R. Durbin, Fast and accurate short read alignment with Burrows-Wheeler transform. Bioinformatics 25, 1754-1760 (2009).
34. R. T. Leenay et al., Identifying and Visualizing Functional PAM Diversity across CRISPR-Cas systems. Molecular Cell 62, 137-147 (2016).
35. R. J. Bainton, K. M. Kubo, J. N. Feng, N. L. Craig, Tn7 transposition: target DNA recognition is mediated by multiple Tn7-encoded proteins in a purified in vitro system. Cell 72, 931-943 (1993).
36. B. Ton-Hoang et al., Transposition of ISHp608, member of an unusual family of bacterial insertion sequences. EMBO J 24, 3325-3338 (2005).

TABLE 21

DNA Sequences

| Protein | Accession | DNA Sequence |
| --- | --- | --- |
| ShTnsB (SEQ ID NO: 956) | WP_084763316.1 | atgaacagtcagcaaaatcctgatttagctgttcatcccttggcaattcctatggaaggcttactaggagaaa gtgctacaactcttgagaagaatgtaattgccacacaactctcagaggaagcccaagtaaagctagaggtaat ccaaagtttactggaaccctgcgatcgcacaacttatgggcaaaagttgcgggaagcagcagagaaactaaat gtatcgttgcgaacggtacaaaggttggtgaaaaactgggaacaagatggcttagtcggactcactcaaacaa gtagggctgataaaggaaaacaccgcattggtgagttttgggaaaacttcattaccaaaacctacaaggaggg taacaagggaagtaaacgtatgaccccctaaacaagttgctctcagagtcgaggctaaagcccgtgaattaaaa gactctaagccgcccaattacaaaaccgtgttacgggtattagcacccattttggaaaagcaacaaaaagcca agagtatccgcagtcctggttggagaggaactacgctttcggttaaaacccgtgaaggaaaagatttatcggt tgattacagtaaccatgtttggcaatgtgaccatacccgcgtggatgtgttgctggtagatcaacatggtgaa atttaagtcgtccctggctaacaacagtaattgatacttactctcgttgcattatgggtatcaactttggct ttgatgcacccagttctggggtagtagcattagcgttacgccatgcaattctaccaaagcgttacggttccga gtacaaactgcattgtgagtggggaacctatggaaaaccagaacattttatactgatggcggtaaagacttt cgctctaaccacttgagtcagattggggcgcaattgggatttgtctgtcatttacgcgatcgcccttctgaag gtggagtagtagaacgtcccttcaaaacattaaatgaccaactattttcaacgcttcctgggtacaccggatc taatgtgcaggaacgcccagaagatgcagagaaggacgcaagacttacttgcgagaactagaacagttactt gtgcgttacatcgtagatcgttacaaccaaagtattgatgcgcggatgggcgaccaaacgcgctttgagcgtt gggaagcaggattgcctacagtgccagtaccaataccagaacgagatttggatatttgtttaatgaagcagtc acggcgcactgtgcaaagaggtggttgtttgcagtttcagaatttaatgtatcgggggggaatatttggcaggt tatgccggagaaactgtcaacttaaggttttgacccccagagacattacaacaattttggtttatcgccaggaaa acaatcaggaagtatttctgactcgcgctcacgctcaaggtttggagacagagcaactggcattagatgaggc tgaggcagcaagtcgcagactccgtaccgcagggaaaactatcagtaaccaatcattattgcaagaagttgtt gaccgcgatgctcttgtcgctaccaagaaaagccgtaaggagcgtcaaaaattggaacagactgttttgcgat ctgctgctgttgatgaaagtaatagagaatccttgccttctcaaatagttgaaccagatgaagtggaatctac agaaacggttcactctcaatacgaagacattgaggtgtgggactatgaacaacttcgtgaagaatatgggttt taa |
| ShTnsC (SEQ ID NO: 957) | WP_029636336.1 | atgacagaagctcaggcgatcgccaagcagttgggtggggtaaaaccggatgatgagtggttacaagctgaaa ttgctcgtctcaagggtaagagcattgtgcctttacagcaggtaaaaactctccatgattggttagatggcaa gcgcaaggcaagaaaatcttgccgagtagttggggaatcgagaactggcaagacagttgcttgtgatgcctac agatacaggcacaaacctcagcaggaagctggacgacctccaactgtgcctgtcgtttatattcgacctcacc aaaaatgtggccccaaggatttgtttaaaaagattactgagtacctcaagtatcgggtaacaaaagggactgt atctgattttcgagataggacgatagaagtactcaagggttgtggcgtagagatgctaattattgatgaagct gaccgtctcaagcctgaaacttttgctgatgtgcgagatattgccgaagatttaggaattgctgtggtactgg taggaacagaccgtttggatgcggtaattaagcgggatgagcaggttctcgaacgctttcgggcgcatcttcg ctttggtaaattgtcgggagaggattttaagaacaccgtagaaatgtgggaacaaatggttttgaaactgcca gtatcttctaatctaaagagcaaggagatgctacggattctcacgtcagcaactgaaggctacattggtcgcc ttgatgagattcttagggaagctgcaattcgttccttatcaagaggattgaagaagattgacaaggctgtttt acaggaagtagctaaggagtacaa |
| ShTniQ (SEQ ID NO: 958) | WP_029636334.1 | atgataagaagcaccagatgttaaaccttggctattcttgattaaaccctatgaagggggaaagcctgagccact ttcttggcaggttcagacgtgccaaccatttatccgcaagtggattgggtactttggcaggaattggtgctat agtggcacgttgggaaagatttcattttaatcctcgccctagtcagcaagaattggaagcgatcgcatctgta gtagaagtgGCAgctcaaaggttagcccagatgttaccgcctgctggagtgggaatgcagcatgagccaattc gcttgtgtggggcttgttatgccgagtcgccttgtcaccgaattgaatggcagtacaagtcggtgtggaagtg |

TABLE 21-continued

DNA Sequences

| Protein | Accession | DNA Sequence |
|---|---|---|
| | | cgatcgccatcaactcaagattttagcaaagtgtccaaactgtcaagcacctttttaaaatgcctgcgctgtgg<br>gaggatgggtgctgtcacagatgtaggatgccgtttgcagaaatggcaaagctacagaaggtttga |
| ShCas12k<br>(SEQ ID<br>NO: 959) | WP_029636312.1 | atgagtcaaataactattcaagctcgacttatttcctttgaatcaaaccgccaacaactctggaagttgatgg<br>cagatttaaacacgccgttaattaacgaactgctttgccagttaggtcaacaccccgacttcgagaagtggca<br>acaaaagggtaaactcccgtcaccgttgtgagccagttatgtcaacctctcaaaactgaccctcgctttgca<br>ggtcagcccagccgtttatatgtcggcaattcatattgtggactacatctacaagtcctggctggctatac<br>agaaacggcttcaacagcagctagatggaaagacgcgctggctagaaatgctcaatagcgatgctgaattagt<br>agaacttagtggtgacacttagaggctattcgtgtcaaagctgctgaaattttggcaatagctatgccagca<br>tctgagtcagatagcgcttcacctaaagggaaaaaaggtaaaaaggagaaaaaaccctcatcttctagcccta<br>agcgtagtttatccaagacattatttgacgcttaccaagaaacggaagatatcaagagccgtagcgccatcag<br>ctacctgttaaaaaatggctgcaaacttactgacaaagaagaagattcagaaaaatttgctaaacgtcgtcgt<br>caagttgaaatccaaattcaaaggcttaccgaaaagttaataagtcggatgcctaaaggtcgagatttgacca<br>atgctaaatggttggagacactcttgactgctacaaccactgttgctgaagacaacgcccaagccaaacgctg<br>gcaggatattctgttaactcgatcaagttctctcccattccccttgttttttgaaaccaacgaggatatggtt<br>tggtcaaagaatcaaagggtaggctgtgtgttcacttcaatggcttaagcgatttaattttgaggtgtact<br>gcggcaatcgtcaacttcactggtttcaacgcttcctagaagaccaacaggcagttcaaatacccttgatgt<br>gcattctagcggcgttgttcacactcagaaatggtcatctagtttggcttgaaggtgagggtaaaggggaacct<br>tggaatcttcaccacttgaccctttactgctgtgttgacaatcgcttgtggacagaggagggaacagaaatcg<br>ttcgccaagagaaagcagatgaaattactaaattcatcacaaacatgaagaagaaagcgatctaagcgatac<br>acagcaagctttgattcaacgtaaacaatcaacacttcgaataaaacaattcattgagcgtcctagccaac<br>ccctttatcaaggtcaatcacacattttggttggagtaagctcgggactagaaaaacctgccacagtagcagt<br>agtagatgcgatcgccaacaaagtcttggcttaccggagtattaaacaattacttggcgacaattacgaactg<br>ctaaatcgccagagacgacaacagcagtacctatctcacgaacgccacaaagcacaaaaaaacttctctccca<br>atcaatttggagcatctgagttagggcaacatatagacagattattagctaaagcaattgtagcgttagcgag<br>aacctacaaagctggcagtattgtcttgcccaagttaggggatatgcgggaggttgtccaaagtgaaattcaa<br>gctatagcagaacaaaaatttcccggttatattgaaggtcagcaaaaatatgccaaacagtaccgggttaatg<br>ttcatcggtggagctacggcagattaattcaaagcattcaaagtaaagcagctcaaacaggaattgtgattga<br>ggagggaaaacaacctattcgaggtagtccccacgacaaagcaaaggaattagcactttctgcttacaatctc<br>cgcctaactaggcgaagttaa |
| AcTnsB<br>(SEQ ID<br>NO: 960) | AFZ56182.1 | atggcagacgaagaatttgaatttactgaaggaacgacgcaagttccagatgctattttgcttgacaagagta<br>attttgtggtagatccatcccaaattattctggcaacgtcggatagacataaactgacatttaatctaatcca<br>gtggcttgctgaatctcccaaccgcactattaagtctcagagaaaacaggcagttgcaaatacccttgatgtt<br>tctactcgccaggtggaacgtcttctcaagcaatacgatgaagacaagttaagagagacagcaggaatagaac<br>gagccgataagggaaaatatcgagttagcgaatattggcaaaacttcatcacaacaatctatgaaaagagtct<br>gaaagaaaaacatccaatatccaccagcatccatagttcgtgaagtgaagcgacacgcaattgtggatcttgaa<br>cttaagctaggagaatatcctcatcaagcccactgtttatagaagttttagatccttaactgcagcaacgaaac<br>ggaaaacaagagttagaaatccgggttcgggatcttggatgacagtagtaacacgagatggagagttacttag<br>ggctgactttagtaaccaaattattcagtgtgaccatactaaattggatgttcgcatagttgataatcatggc<br>aatttactgtctgatcgtccttggctaactactattgtggatacttttcaagctgtgttgttggttttcgct<br>tatgattaaacaacccggttctacagaggtggcttagcttaagacacgctattttacctaaaaactaccc<br>tgaagattatcaacttaataagtcttgggatgtatgtggacaccccatcaatatttttttactgatggtggt<br>aaagattttcgctcaaaacatctcaaagctattggtaagaaattaggatttcagtgtgaattacgcgatcgcc<br>caccggaaggtggtattgtggaacggattttcaaaactattaatactcaagttctcaaagagttacctggtta<br>tacagggtcaaatgttcaggaacgcccagaaagtacagagaaagaagcctgtttaactattcaggatttggat<br>aagattctcgctagttctcttttgtgatatctataatcacgagccttatcctaaagagccctcgtgatacgagat<br>ttgaacgctggtttaagggtatgggaggaaaactacctgaacctttggatgagcgagaattagatatttgttt<br>gatgaaagaagccaacgagttgttcaagctcatggatctattcaatttgaaaacctgatttatcggggagaa<br>tttctcaaagcacataaaggtgaatatgtaacgctgagatatgatcccagatcatatcctgagttttatatct<br>acagtggtgaaactgatgataatgcaggagaattttttgggttatgctcatgccgttaatatggataccatga<br>tttaagtatagaagaattaaaagccctgaataaagagagaagtaatgctcgtaaggagcattttaactatgat<br>gctttattagcattgggtaaacgtaaagaacttgtagaggaacgaaagaggataaaaaggcaaaagaaact<br>cagaacaaaagcgtctccgttctgcatccaagaaaaattccaatgttattgaactacgcaaaagtaggacttc<br>caaatctttgaagaaacaagaaaatcaggaagttttaccagagagaatttccagggaagaaatcaagcttgag<br>aagatagaacagcaaccacaggaaatctatcagcttcacctaacactcaagaagaagagagacataagttag<br>ttttctctaaccgtcaaaaaaatttgaacaagatttggtaa |
| AcTnsC<br>(SEQ ID<br>NO: 961) | AFZ56183.1 | atggcgcaacctcaacttgcaactcaatctattgttgaagtcctagccccaaggttagacatcaaagctcaaa<br>ttgctaaaactattgatattgaagagattttagagcttgttttatcactactgatcgggcttcggaatgctt<br>cagatggttagatgaattgcgtattctcaacaatgtggtcgaatcattggaccaagaaatgtgggaaaaagc<br>agagccgcgcttcactatcgagatgaggataaaaacgagtttcctatgtaaaggcttggtctgcatcgagtt<br>ctaagcgtctattttcacaaatcctgaaggatattaatcatgctgaccaaacgatgaaacgacaggatttacg<br>tccaagattagcgggtagtctggaactatttggattggaattggtggattatagataatgcggaaaatcttcaa<br>aaagaagcactgctagacttgaaacaacttttttgaagagtgtaatgttcctattgttttagctggaggtaagg<br>agttagatgatcttttacacgattgtgatttgttgactaattcccaacactctatgagtttgaacggttgga<br>atatgatgattcaaaaaaacattaactacaattgaattggatgttttatctcttccagaagcatctaattta<br>gctgagggcaatattttgagattttagcagttagtacagaagcacgaatgggaattttaatcaagatactaa<br>ctaaggctgttttacattctctcaaaaatggatttcaccgagttgatgaaagtattttagaaaaaattgctag<br>tcgttatggcacaaaatatattcctctcaaaaacagaaatagggattga |
| AcTnsQ<br>(SEQ ID<br>NO: 962) | AFZ56184.1 | atggcacaaaatatattcctctcaaaaacagaaatagggattgatgaagatgatgaaattcgcccaaagttag<br>gctatgttgaacctatgaggaggagagtattagtcattatctagggcgtttgcgacggttaaggctaacag<br>cctaccgtcaggatactctttgggaaaaattgctggactcggtgcaatgattcacgttgggagaagctttat<br>ttcaatccttttcctactctacaagagttggaggctttgtcctctgtggtgggagttaatgcagatagattaa<br>tagaaatgctccctctcagggaatgacgatgaagcctagaccaattaggttatgtgggggcttgttatgcaga |

TABLE 21-continued

DNA Sequences

| Protein | Accession | DNA Sequence |
|---|---|---|
| | | atctccttgtcatcggattgagtggcagtgtaaggatagaatgaaatgcgatcgccacaatttacgtttatta<br>ataaaatgtactaattgtgaaactcctttcccgattcccgcagattgggttaaaggtcaatgtcctcattgtt<br>ccctgccttttgcaaagatggcgaaaaggcaaaggcgtgattag |
| AcCas12k<br>(SEQ ID<br>NO: 963) | AFZ56196.1 | atgagcgttatcacaattcaatgtcgcttggttgctgaagaagacagcctccgtcaactatgggaattgatga<br>gtgaaaaaaatacaccattcatcaatgaaattttgctacagataggaaaacacccagaatttgaaacctggct<br>agaaaaaggtagaataccggctgaattactcaaaacactgggtaactccctgaaaactcaagaacctttact<br>ggacaacctggacgtttttacacctcagcgattactttagtggattatctgtataaatcctggtttgctttac<br>agaaacgcagaaagcagcaaatagaagggaaacgcgttggctaaaaatgctcaaaagtgatcaagaacttga<br>gcaagaaagtcaatctagcttagaagtaatccgtaataaagccactgaacttttagcaaatttaccccctcag<br>tccgatagcgaagcgctccgtaggaatcaaaatgacaaacagaaaaaggtaaaaaagactaaaaaatccacaa<br>aaccgaaaacatcttcaattttcaaattttttttaagcacttacgaagaagcggaagaacctcttactcgttg<br>cgctcttgcatatctactcaaaaataactgtcaaattagtgaactggatgaaaacccagaagaatttaccaga<br>aataagcgcagaaaagaaatagaaattgagcgattaaaagatcaactccaaagtcgcatcccaaaggtagag<br>atttgacaggagaagaatggttagaaaccttagaaattgccaccttcaatgttccgcaaaatgaaatgaagc<br>aaaagcatggcaagcagcacttttaagaaaaactgctaatgttccctttcctgtagcttatgaatctaacgag<br>gatatgacatggttaaagaatgataaaaatcgtctctttgtacggttcaatggcttgggaaaacttacttttg<br>agatttactgcgataagcgtcatttgcactacttccaacgctttttagaggatcaagaaattctacgcaatag<br>taaaaggcagcactcaagcagtttgtttactctacgctcaggaagaatagcttggttgccaggtgaagaaaaa<br>ggtgaacattggaaagtaaatcaactaaattttttattgttctttagatactcgaatgctgactaccgaaggaa<br>ctcaacaggtagttgaggagaaagttacagcaattaccgaaattttaaataaaacaaaacagaaagatgatct<br>caacgataaacaacaagctttttattactcgtcagcaatcaacactagctcgaattaataacccttttcctcgt<br>cccagtaaacctaattatcaaggtaaatcttctatcctcataggtgttagttttggactagaaaaaccagtca<br>cagtagcagtcgtagatgttgttaaaaataaagttatagcttatcgcagtgtcaaacaactacttggtgaaaa<br>ctataatcttctgaatcgtcagcgacaacaacagcaacgcctatctcacgaacgccacaagcccaaaaacaa<br>aatgcacccaactcttttggtgaatctgaattaggacaatatgtggatagattgttagcagatgcaattattg<br>cgatcgctaaaaaatatcaagctggcagtatagttttacccaaactccgcgatatgcgagagcaaatcagcag<br>tgaaattcaatccagagcagaaaatcaatgccctggttacaaagaaggccaacaaaaatacgccaaagaatat<br>cgaataaacgttcatcgctggagttatggacgattaatcgagagtatcaaatcccaagcagcacaagctggaa<br>ttgcaattgaaactggaaaacagtcaatcagaggcagtccacaagaaaaagcacgagatttagccgtcttttac<br>ttaccaagaacgtcaagctgcgctaatttag |

TABLE 22

RNA Sequences

| RNA | Sequence (5' to 3') |
|---|---|
| ShCas12k tracrRNA1<br>(SEQ ID NO: 640) | AGGUGCGCUCCCAGCAAUAAGGGCG<br>CGGAUGUACUGCUGUAGUGGCUACU<br>GAAUCACCCCCGAUCAAGGGGGAAC<br>CCUCCC |
| ShCas12k tracrRNA2<br>(SEQ ID NO: 641) | AGACAGGAUAGGUGCGCUCCCAGCA<br>AUAAGGGCGCGGAUGUACUGCUGUA<br>GUGGCUACUGAAUCACCCCCGAUCA<br>AGGGGGAACCCUCC |
| ShCas12k tracrRNA3<br>(SEQ ID NO: 642) | AAAUACAGUCUUGCUUUCUGACCCU<br>GGUAGCUGCUCACCCUGAUGCUGCU<br>GUCAAUAGACAGGAUAGGUGCGCUC<br>CCAGCAAUAAGGGCGCGGAUGUACU<br>GCUGUAGUGGCUACU |
| ShCas12k tracrRNA4<br>(SEQ ID NO: 643) | AAAUACAGUCUUGCUUUCUGACCCU<br>GGUAGCUGCUCACCCUGAUGCUGCU<br>GUCAAUAGACAGGAUAGGUGCGCUC<br>CCAGCAAUAAGGGCGCGGAUGUACU<br>GCUGUAGUGGCUACUGAAUCACCCC<br>CGAUCAAGGGGGAACCCUC |
| ShCas12k tracrRNA5<br>(SEQ ID NO: 644) | UUUAAAUGAGGGUUUAGUUUGACUGUA<br>UAAAUACAGUCUUGCUUUCUGACCC<br>UGGUAGCUGCUCACCCUGAUGCUGC<br>UGUCAAUAGACAGGAUAGGUGCGCU<br>CCCAGCAAUAAGGGCGCGGAUGUAC<br>UGCUGUAGUGGCUACUGAAUCACCC<br>CCGAUCAAGGGGGAACCCU |
| ShCas12k tracrRNA6<br>(SEQ ID NO: 645) | AUAUUAAUAGCGCCGCAAUUCAUGC<br>UGCUUGCAGCCUCUGAAUUUUGUUA<br>AAUGAGGGUUUAGUUUGACUGUAUAA<br>AUACAGUCUUGCUUUCUGACCCUGG<br>UAGCUGCUCACCCUGAUGCUGCUGU<br>CAAUAGACAGGAUAGGUGCGCUCCC<br>AGCAAUAAGGGCGCGGAUGUACUGC<br>UGUAGUGGCUACUGAAUCACCCCCG<br>AUCAAGGGGGAACCC |
| ShCas12k sgRNA6.1*<br>(SEQ ID NO: 646) | AUAUUAAUAGCGCCGCAAUUCAUGC<br>UGCUUGCAGCCUCUGAAUUUUGUUA<br>AAUGAGGGUUUAGUUUGACUGUAUAA<br>AUACAGUCUUGCUUUCUGACCCUGG<br>UAGCUGCUCACCCUGAUGCUGCUGU<br>CAAUAGACAGGAUAGGUGCGCUCCC<br>AGCAAUAAGGGCGCGGAUGUACUGC<br>UGUAGUGGCUACUGAAUCACCCCCG<br>AUCAAGGGGGAACCCUCCAAAAGGU<br>GGGUUGAAAGnnnnnnnnnnnnnnn<br>nnnnnnnn |
| ShCas12k sgRNA6.2*<br>(SEQ ID NO: 647) | AUAUUAAUAGCGCCGCAAUUCAUGC<br>UGCUUGCAGCCUCUGAAUUUUGUUA<br>AAUGAGGGUUUAGUUUGACUGUAUAA<br>AUACAGUCUUGCUUUCUGACCCUGG<br>UAGCUGCUCACCCUGAUGCUGCUGU<br>CAAUAGACAGGAUAGGUGCGCUCCC<br>AGCAAUAAGGGCGCGGAUGUACUGC<br>UGUAGUGGCUACUGAAUCACCCCCG<br>AUCAAGGGGGAACCCUAAAUGGGUU<br>GAAAGnnnnnnnnnnnnnnnnnn<br>nnn |
| ShCas12k crRNA*<br>(SEQ ID NO: 648) | AAGGAGGGAAGAAAGnnnnnnnnnn<br>nnnnnnnnnnnnn |

*23 nt guide sequences added to the 3' end of sgRNA and crRNA

TABLE 23

Genomic targets and primers
(SEQ ID NO: 649-792, where guide sequence is SEQ ID NO: 649, forward primer
is SEQ ID NO: 650, and reverse primer is SEQ ID NO: 651, etc.)

| Proto-spacer | PAM | Guide sequence (24 nt) | Forward primer | Reverse primer | Position |
|---|---|---|---|---|---|
| 2 | TGTG | TCAGAAGGTTAGCATCAAATGAT | AGATAACCGGGCACGTTTTT | TTCCTCCACATCCACTGTCT | 37315 |
| 3 | GGTA | TGTGAAGTAATACCCTAACCACC | GAGCCGGTGTGGAATGGTAA | ATTCTGGCGCTTGCTACCTT | 4455464 |
| 4 | CGTT | TTACATGTCCTGTACCCGGCAGA | ACGAAAGGCAGGTGAGAAGG | ACCATTCTCACCCGGCAATT | 61356 |
| 5 | CGTT | ATAGTGAATCCGCTTATTCTCAG | ACGTTCGAAAGGCGTACCAA | TGAGTGCCATTGTAGTGCGA | 1445845 |
| 6 | AGTG | GGATTCACACAACGAAACAATTA | CAGGATCCAGGATTCACGGG | AACCGGGTATTCCACACACC | 208056 |
| 7 | CGTT | TATTGCGAAGGGAGGGTGACGAA | TTGGTAGACGCGCTAGCTTC | TCGGTTTCGCCATCACATGA | 647688 |
| 8 | CGTT | CTGTGCCAAAAGCGGAAGTTGGA | AGCCAGAAATATGCCGAGCC | GGCAGACCAGAAAGCGTTTG | 1855018 |
| 9 | AGTT | CTGTAACGTAATCATTAACATGC | GCGGCCGCCAATTTTAGTTT | GCTCGGCATATTTGTCTGCG | 853988 |
| 10 | AGTC | TCAGACCTATTTGGCCGGTAATC | CAGATTGCCGCGGCTTTAAT | GTCCCAGTCCGATCTCTTGC | 2762104 |
| 11 | GGTA | ATGCCGGTCATTCCGGGGTTTTG | CGTTTCGTTTTCCGGTGCTT | AAGAAGCCTCACCACAACCC | 164858 |
| 12 | CGTT | TTAGGATAATTGGAATGAATATC | CGCGTCTTATCAGGCCTACA | ACCCAAAAACATTTCGGGCG | 393437 |
| 13 | TGTA | TTCAAAGAGTATAAATGCCTGA | TGGGTTGAACATAACGCCGA | GCAAGTAAGCCCGCAATAGC | 1343329 |
| 14 | TGTG | TTTGCGGCATTAACGCTCACCAG | GAACGGCCTCAGTAGTCTCG | TGTTTAGAGTGTTCCCCGCG | 1726131 |
| 15 | TGTT | ACCCTCTTAAACTATCCCACTAA | AAGGCTGGGAAATCAGACGG | TATCTGCAAAGTCGCTGGGG | 3058735 |
| 16 | TGTC | AACCTCACTACTATCGAAGACTC | CGATTGGCATTAACCCGCTT | AAACGGCACATTCAACTGGC | 2167400 |
| 17 | AGTA | TAAAAAACGAACGATAACCGTGA | GCACAACACTGCCTGAAACA | GATGAACACGCGGACGAGTA | 2665227 |
| 18 | GGTT | GAGACTGTTGATAAAACGTAAAA | CATCAGCATTCCTGGCCGTA | ACGCCCGTGACAGTAAACAT | 999636 |
| 19 | AGTC | AGATGTTATTTTTACTCACAAC | CGGGTGAATAGAGGGCGTTT | TCAGGCACGCACTTATAGCA | 4541043 |
| 20 | AGTC | GTTCTGTACACTTTGTTTTGTCA | GCTCGACGCATCTTCCTCAT | GGACAGAGCCGACAGAACAA | 87136 |
| 21 | GGTA | AAGTTTGGTAGATTTTAGTTTGT | ACACAGGTTTATCCCCGCTG | CGCCTCTGAAAACTCCTCCA | 1725870 |
| 22 | TGTG | TTAATGAAACCTTCTTGACGCTG | CTGGCGCTCATCAACAATCG | CAATTTTGCCTTCCCCGAGC | 1435660 |
| 23 | CGTT | TAGCTTATATTGTGGTCATTAGC | CGACCGACGATTATCCCCTG | AGCACGAGGGTCAGCAATAC | 259290 |
| 24 | CGTT | ACCACCTCAAGCTATGCCGCCAG | TTGGTAGGCCTGATAAGCGC | GTAGCAGATGACCTCGCCTC | 550349 |
| 25 | TGTC | TATTCATCGTGTTGATAAGATAT | TGTGATGTTCTACGGGCAGG | CTCAGCGATCACCCGAAACT | 964477 |
| 26 | GGTC | TTTACTTGCTCATCGTTATAATT | TTAAACCGTGGGAAGGAGGC | TTTTGCGAGGCGTTTTCCAG | 551608 |
| 27 | AGTA | AAAACTGCTTCATAGCGCGGATT | GCAGTATAAAAAGCGCGCCA | GCTGTTGATTGACGCCAGTG | 1707979 |
| 28 | GGTT | TTTTATACCTGTAGATCATCATA | CAGGTGTCAGGTCGGAAACA | GCCGATAGTGTTCCTTGCCT | 1647991 |
| 29 | AGTT | CTCTTCGGACTTCGCGGGACAAA | TTTGTTAGTGGCGTGTCCGT | TTTGGCGGCTTTGATTTCCG | 1874378 |
| 30 | AGTC | TGAGTTATTTTGTAGGGCTATA | AGTTTGCGGGTGATGAGAG | AATGACACACAAGACCAGCT | 4077502 |
| 31 | GGTA | ACGCCGTGAAAAGACGGGCTTAC | GGTCAGCCGATTTTGCATCC | GAAATGTCTTCAGGCGTGGC | 160388 |
| 32 | GGTA | ACCAGTTCAGAAGCTGCTATCAG | TCATGGCATTGCTGACGACT | CTGTCTGTGCGCTATGCCTA | 4587210 |
| 33 | CGTT | TTGTTAAAAATGTGAATCACTT | GTTCTTCAGCAGGCGGGATA | GATGACGAGTGGTACTCCGC | 2556691 |
| 34 | TGTA | GTCTGCGATCCTGCCAGCAAATA | GGAGAGGCTTTCCCGTTTCA | TAGACTGCTTGCATGGCGAA | 2470836 |
| 35 | CGTA | ATTTTGGTGAGACCCAAAATCGA | GCTCCACTTTTCCACGACCA | GTGGTCTGATCCAGCGTTGA | 2991491 |
| 36 | TGTG | GATATTGTGATACACATTGAGGT | TGTGGCGAAGTTGAGATACCA | ACTATCTGAACTCTTCGTGGCT | 4562646 |
| 37 | TGTC | AGAAGGTTAGCATCAAATGATAA | GCATTCTGCGGGAAGGGATA | TTTTGCAGCATCCTGGCAAC | 37317 |

TABLE 23-continued

Genomic targets and primers
(SEQ ID NO: 649-792, where guide sequence is SEQ ID NO: 649, forward primer
is SEQ ID NO: 650, and reverse primer is SEQ ID NO: 651, etc.)

| Proto-spacer | PAM | Guide sequence (24 nt) | Forward primer | Reverse primer | Position |
|---|---|---|---|---|---|
| 38 | GGTG | GATGGAAAGGTGATTGAAAACTC | AACCAGCGTTGACCATTTGC | ATAACTTCCAGTGGGCGTGG | 994483 |
| 39 | GGTT | TTACCCCTGTTACACGGGAAGTG | AGTAGTTCTGACAACGGGCG | CAACTCCGCTGGCAGAAAAG | 41015 |
| 40 | TGTC | AATGGGTGGTTTTTGTTGTGTAA | CAAATTATACGGTGCGCCCC | TCGGCGCTAAGAACCATCAT | 707736 |
| 41 | AGTT | TTGTCAGATATTACGCCTGTGTG | TATCCACCCGTGCGATTACG | CCAGAATGACCTCGGCAACT | 2687062 |
| 42 | AGTG | ACTATAGACTATCCGGGCAATGT | TGAGTGCCAGAATCTTGCGT | ACGTACTTCGCCACCTGAAG | 188387 |
| 43 | GGTG | ATTTTGTGATCTGTTTAAATGTT | GAGCGAAAACAGCAGCCATC | GTCATGATTGGCCTGCGTTC | 1138064 |
| 44 | TGTG | TCTGTAAATCACGACAATGGGTG | AGTCGGTGAATGAGCCACTG | GCAGTTGGGGTAAGTCGTCA | 1938877 |
| 45 | AGTC | ACTGCCCGTTTCGAGAGTTTCT | GCAGGCTCGGTTAGGGTAAG | GGCTAACGTGGCAGGAATCT | 470870 |
| 46 | TGTA | GGCCGGACAAGACGTTTATCGCA | TGTAGGCCTGATAAGACGCG | TGAAGGGGTACGAGTCGACA | 4225144 |
| 47 | AGTG | GTGCTGATAGGCAGATTCGAACT | AGGTAGCCGAGTTCCAGGAT | TACGGTAGTGATTGCAGCGG | 453402 |
| 48 | AGTT | GGTGGCTCTGGCTGGAGTGAGAG | CCTCCGCCAGCTGAAGAAAT | CCAGACGGGTTTCATCAGCA | 982236 |
| 49 | AGTT | ATAGCGATCCCTTGCTGAAAATA | GTCAGGTAGCCAGAACACCC | GCCGGGATACGTTCCTTCTT | 762880 |

TABLE 24 ddPCR primers and probes

| | |
|---|---|
| Insert Probe | CTGTCGTCGGTGACAGATTAATGTCATTGTGAC (SEQ ID NO: 793) |
| Target Probe | TGGGCAGCGCCCACATACGCAGCGATTTC (SEQ ID NO: 794) |
| pTarget Forward Primer | AAAACGCCTAACCCTAAGCAGATTC (SEQ ID NO: 795) |
| pTarget Reverse Primer | GGTGCCGAGGATGACGATGAG (SEQ ID NO: 796) |
| T14 LE Reverse Primer | AACGCTGATGGGTCACGACG (SEQ ID NO: 797) |

TABLE 25

Off-target insertions

| Genome Position (bp) | Ratio to on-target | | | Nearby Genes |
|---|---|---|---|---|
| | PSP15 | PSP42 | PSP49 | |
| 37000-37999 | 4.30E-03 | 1.40E-04 | 1.90E-04 | tRNA-Leu |
| 147000-147999 | 1.60E-03 | 1.30E-03 | 1.10E-03 | valS |
| 200000-200999 | 2.50E-03 | 1.60E-03 | 1.90E-03 | rolI, rpsR, priC, rpsF |
| 439000-439999 | 1.40E-03 | 9.70E-04 | 1.20E-03 | rpoC, rpoB, rplL, rplJ |
| 627000-627999 | 2.80E-03 | 1.90E-03 | 2.40E-03 | corA |
| 755000-755999 | 2.20E-03 | 1.40E-03 | 1.70E-03 | gyrB, recF, dnaN |
| 763000-763999 | 2.20E-04 | 1.60E-04 | 5.50E-03 | IbpA, IbpB |
| 764000-764999 | 5.70E-04 | 3.20E-04 | 1.60E-03 | IbpA, IbpB |
| 765000-765999 | 2.10E-04 | 1.10E-04 | 1.40E-03 | IbpA, IbpB |
| 766000-766999 | 6.20E-04 | 3.50E-04 | 1.50E-03 | IbpA, IbpB |
| 831000-831999 | 2.10E-03 | 1.50E-03 | 2.00E-03 | waaU, rfaJ, rfaY, rfaI, rfaS |
| 832000-832999 | 1.50E-03 | 1.00E-03 | 1.60E-03 | waaU, rfaJ, rfaY, rfaI, rfaS |
| 909000-909999 | 1.30E-03 | 9.60E-04 | 1.40E-03 | glyS |
| 924000-924999 | 2.60E-05 | 9.70E-05 | 2.90E-05 | tRNA-Pro |
| 1245000-1245999 | 1.80E-03 | 1.50E-03 | 1.30E-03 | ArgS |
| 1385000-1385999 | 1.60E-03 | 1.40E-03 | 1.30E-03 | uxaC, uxaA, ygjV, SstT |
| 1531000-1531999 | 1.80E-03 | 1.70E-03 | 1.50E-03 | TrmB, C4J69-19770, yggN |
| 1542000-1542999 | 1.50E-03 | 1.30E-03 | 1.10E-03 | metK, galP |
| 1724000-1724999 | 2.60E-03 | 2.30E-03 | 2.10E-03 | eno, pyrG, A610-3350 |
| 1944000-1944999 | 1.30E-03 | 1.20E-03 | 1.00E-03 | glyA, hmp |
| 2234000-2234999 | 2.00E-03 | 1.80E-03 | 1.90E-03 | NuoN, NuoM |
| 2364000-2364999 | 1.50E-03 | 1.20E-03 | 1.30E-03 | fruA, fruK, fruB |
| 3420000-3420999 | 1.30E-03 | 1.10E-03 | 1.20E-03 | nagK, NudJ, IolD, IolE |
| 3661000-3661999 | 4.30E-03 | 3.10E-03 | 3.40E-03 | serS |
| 3838000-3838999 | 1.50E-03 | 1.10E-03 | 1.30E-03 | sucB, sucA, sdhB, sdhA |
| 3895000-3895999 | 1.80E-03 | 1.70E-03 | 1.30E-03 | glnS |
| 4168000-4168999 | 1.90E-03 | 1.30E-03 | 1.50E-03 | secF, secD, YajC, tgt, QueA |
| 4304000-4304999 | 1.90E-03 | 1.20E-03 | 1.50E-03 | tRNA-thr |

TABLE 26

NGS primers

| | |
|---|---|
| pTarget Primer LE | CTTTCCCTACACGACGCTCTTCCGATCTCGCAGACCAAAACGATCTCAAG (SEQ ID NO: 798) |
| pTarget Primer RE | CTTTCCCTACACGACGCTCTTCCGATCTGGTGCCGAGGATGACGATGAG (SEQ ID NO: 799) |

TABLE 26-continued

NGS primers

| | | |
|---|---|---|
| T14 LE Primer | GACTGGAGTTCAGACGTGTGCTCTTCCG<br>ATCTAATGACATTAATCTGTCACCGACG<br>(SEQ ID NO: 800) | |
| T14 RE Primer | GACTGGAGTTCAGACGTGTGCTCTTCCG<br>ATCTATGCTAAAACTGCCAAAGCGC<br>(SEQ ID NO: 801) | |
| T1 LE Primer | GACTGGAGTTCAGACGTGTGCTCTTCCG<br>ATCTCTCTGAAAAACAACCACCACGAC<br>(SEQ ID NO: 802) | |
| T1 RE Primer | GACTGGAGTTCAGACGTGTGCTCTTCCG<br>ATCTCGCTTTTCGCAAATTAGTGTCG<br>(SEQ ID NO: 803) | |

Example 11—Binding of Cas12k with DNA in Human Cells

This example demonstrates the binding of Cas12k with DNA in human cells. Two Cas12k orthologs (ShCas12k and AcCas12k) were tested.

The constructs were transfected into 293HEK cells. Each gene was driven by a CMV promoter. Guides were designed to target the upstream promoter region driving GLuc. AcCas12k showed significant activation of the reporter. Four different guides were tested for each Cas12k, each guide had a GGTT PAM. Signal was normalized relative to a non-targeting guide under the same conditions.

Cas12k-VP64 had an NLS inserted between Cas12k and VP64. All conditions had tagged TniQ, and the two conditions for each ortholog represent+/−TnsC. The binding signals were stronger at later time point. For example, Cas9 reached about 50-100 folds activation at later time points. The results are shown in FIGS. 59A-59B.

Example 12—CAST Mediated Gene Editing in Eukaryotic Cells

HEK293T cells were transfected with 40 ng of each CAST protein (Cas12k-NLS, TniQ-NLS, NLS-TnsB or TnsB, and TnsC), 40 ng of U6-sgRNA, and 10 ng of target plasmid with 0.6 μL of Minis TransIT-LTI. After 24 hours, 100 ng of linear double-strand DNA donors containing LE and RE and 5' phosphorothioate modifications were transfected with 0.3 μL of Minis TransIT-LTI. Cells were harvested 96 hours after donor transfection and insertions detected by PCR amplification of the targeted plasmid with an LE specific primer followed by deep sequencing. FIG. 60 shows insertion products in the targets (DNMT1, EMX1, VEGFA, GRIN2B).

Amplicons were paired-end sequenced (75 bp forward, 35 bp reverse) on an Illumina MiSeq Instrument. For each target (DNMT1, EMX1, GRIN2B, VEGFA), paired reads were assembled to the respective target plasmid with an estimated insertion position 62 bp downstream of the protospacer adjacent motif (PAM) with the constraint that both the forward and reverse read had to exactly match the estimated insertion product. For each target, greater than 14,000 reads mapping to the estimated insertion product were shown. FIGS. 61A-61D show mapping of the reads for DNMT1, EMX1, VEGFA, GRIN2B, respectively.

Example 13—Example CAST Systems

Exemplary Cas-associated transposase systems, including sequences encoding TnsB, TnsC, TniQ, Cas12k, guide RNA, left end sequence elements and right end sequence elements, are shown in Table 26 below.

TABLE 27

| Name/<br>Organism/<br>System<br>ID (T) | | Sequences |
|---|---|---|
| ANNX02000026/<br>Scytonema<br>hofmannii<br>PCC 7110/<br>T32 | TnsB<br>(SEQ ID<br>NO: 964) | ATGCTGGACGAGGAATTCGAGTTCACCGAGGAACTGACACAGGCCCCTGACGTGATCGTGCTGGACAAGAGCCACT<br>TCGTGGTGGACCCCAGCCAGATCATCCTGCAGACCAGCGACAAGCACAAGCTGCGGTTCAACCTGATCAAGTGGTT<br>CGCCGAGTCTCCCAACATCACCATCAAGAGCCAGCGGAAGCAGGCCGTGGTTGATACCCTGGGAGTGTCCACCAGA<br>CAGGTGGAAAGACTGCTGAAGCAGTACCACAACGGCGAGCTGTCTGAAACAGCCGGCGTGCAGAGAAGCGATAAG<br>GGCAAGCTGAGAATCAGCCAGTATTGGGAAGATTACATCAAGACCACCTACGAGAAGTCCCTGAAGGACAAGCAC<br>CCCATGCTGCCTGCCGCCGTCGTTAGAGAAGTGAAGAGACACGCCATCGTGGACCTGGGACTGAAGCCTGGCGATT<br>ACCCTCATCCTGCCACCATCTACCGGAATCTGGCCCCTCTGATCGAGCAGCACACCCGGAAGAAAAAAGTGCGGAA<br>TCCTGGCAGCGGCAGCTGGCTGACAGTGGTCACAAGAGATGGCCAGCTGCTGAAGGCCGACTTCAGCAACCAGATC<br>ATTCAGTGCGACCACCACCGAGCTGGACATCCACATCGTGGATAGCCACGGCAGCCTGCTGAGCGATAGACCTTGGC<br>TGACCACAGTGGTGGATACCTACAGCAGCTGCATCCTGGGCTTTCACCTGTGGATCAAGCAGCCTGGCAGCACCGA<br>AGTTGCCCTGGCTCTGAGACATGCCATCCTGCCTAAGAACTACCCCGAGGACTACAAGCTGGGCAAAGTGTGGGAG<br>ATCTACGGCCCTCCATTCCAGTACTTTTTCACCGATGGCGGCAAGGACTTCAACAGCAAGCACCTGAAGGCCATCGG<br>CAAGAAACTGGGCTTCCAGTGCGAGCTGCGGAACAGACCTCCTCAAGGCGGCATTGTGGAACGGCTGTTCAAGACC<br>ATCAACACCCAGGTGCTGAAAGAGCTGCCTGGCTACACAGGCGCCAACGTGCAAGAGAGGCCTAAAAACGCCGAG<br>AAAGAGGCCTGCCTGACCATCCAGGATCTGGATAAGATCCTGGCCAGCTTCTTCTGCGACATCTACAACCACGAGCC<br>GTATCCTAAAGAGCCCCGGAACACCAGATTCGAGCGGTGGTTTAAAGGCATGGGCGGCAAGCTGCCTGAGCCTCTG<br>GATGAGAGAAGACTGGATATCTGCCTGATGAAGGAAGCTCAGAGAGTCGTTCAGGCCCCACGGCTCCATCCAGTTCG<br>AGAACCTGATCTACAGAGGCGAGGCCCTGAAAGCCTACAGGGGCGAGTATGTGACCCTGAGATACGACCCCGATCA<br>CGTGCTGACCCTGTACGTGTACTCTTGCGAGGCCGACGACAACGCCGAGGAATTTCTGGGATATGCCCACGCCATCA<br>ACATGGACACCCACGACCTGAGCATCGAGGAACTCAAGACCCTGAACAAAGAGCGGAGCAAGGCCAGAAGCGACC<br>ACTACAACTACGATGCCCTGCTGGCCCTGGGCAAGAGAAAAGAACTGGTGGAAGAGGAGGAAGCAGGACAAGAAGG<br>CCAAGCGGCAGAGCGAGCAGAAGAGACTGAGAACCGCCAGCAAGAAAAACTCCAATGTGATCGAGCTGAGAAAGT<br>CCAGAGCCAGCAGCAGCTCCAGCAAGGACGACCGGCAAGAGATCCTGCCTGAGAGAGTGTCTCGGGACGAGCTGA<br>AGCCCGAGAAAACAGAGCTGAAGTACGAGGAAAACCTGCTCGCCCAGACCGACACACAGAAGCAAGAGCGGCACA<br>AACTGGTGGTGTCGACCGGAAGAAGAACCTGAAGAACATCTGGTGA |
| | TnsC<br>(SEQ ID<br>NO: 965) | ATGGCCATCTCTCAGCTGGCCACACAGCCCTTCGTGGAAGTGCTGCCTCCTGAGCTGGATAGCAAGGCCCAGATCGC<br>CAAGACCATCGACATCGAGGAACTGTTCCGGATCAACTTCATCACCACCGACCGGTCCAGCGAGTGCTTCAGATGG<br>CTGGACGAGCTGCGGATCCTGAAGCAGTGCGGCAGAATCATCGGCCCCAGAAACGTGGGCAAGAGCAGAGCCGTG<br>CTGCACTACCGGAACGAGGACAAGAAACGGGTGTCCTACGTGAAGGCTTGGAGCGCCAGCAGCAGCAAGAGACTG<br>TTCAGCCAGATTCTGAAGGACATCAACCACGCCGCCTCCACCGGCAAGAGACAGGATCTTAGACCTAGACTGGCCG<br>GCAGCCTGGAACTGTTTGGACTGGAACTGGTCATCGTGGACAACGCCGAGAACCTGCAGAAAGAGGCCCTGCTGGA |

TABLE 27-continued

| Name/<br>Organism/<br>System<br>ID (T) | Sequences |
|---|---|
| | CCTCAAGCAGCTGTTCGAGGAATGCCACGTGCCAATCGTGCTCGTCGGCGGAAAAGAGCTGGACGACATCCTGGAA<br>GATTTCGACCTGCTGACCAACTTTCCCACACTGTACGAGTTCGAGCGGCTGGAACACGACGACTTCATCAAGACCCT<br>GAAAACCATCGAGACTGGACATCCTGAGCCTGCCTGAGGCCTCTAAGCTGAGCGAGGGCAACATCTTTGCCATCCTG<br>GCCGAGTCTACCGGCGCAAGATCGGCATCCTGGTCAAGATTCTGACCAAGGCAGTGCTGCACAGCCTGAAGAAAG<br>GCTTCGGCAAGGTGGACGAGTCTATCCTGGAAAAGATCGCCAGCAGATACGGCACCAAATACGTGCCCATCGAGAA<br>CAAGAACCGCAACGACTGA |
| TniQ<br>(SEQ ID<br>NO: 966) | ATGATCGAGGACGACGAGATCAGACTGCGGCTGGGCTACGTGGAACCTCATCCTGGCGAGAGCATCAGCCACTACC<br>TGGGCAGACTGAGAAGATTCAAGGCCAACAGCCTGCCTAGCGGCTATGCCCTGGGAAAGATTGCCGGACTGGGCAG<br>CGTTCTGACCAGATGGGAGAAGCTGTACTTCAACCCATTTCCGACACAGCAAGAGCTGGAAGCCCTGGCTCAAGTG<br>ATCCAGGTGGAAGTGGAAAAGCTGAGAGAGATGCTGCCCACCAAGGGCGTGACCATGATGCCCAGACCTATCAGA<br>CTGTGCGCCGCCTGTTATGCCGAGTCTCCCTACCACAGAATCGAGTGGCAGTTCAAGGACAAGATGAAGTGCGACC<br>GGCACCAGCTGAGACTGCTGACCAAGTGCACCAACTGTCAGACCCCTTTTCCTATTCCTGCCGACTGGGAGAAGGGC<br>GAGTGCAGCCACTGCTTTCTGAGCTTCGCCAAGATGGTCAAGTGCCAGAAACGGCGGTGA |
| Cas12k<br>(SEQ ID<br>NO: 967) | ATGAGCACCATCACCATCCAGTGCAGACTGGTGGCCGAGGAAGCTACCCTGAGATACTTCTGGGAGCTGATGGCCG<br>AGAAGAACACCCCTCTGATCAACGAGCTGCTGGAACAGCTGGGACAGCACCCCGATTTCGACACATGGGTGCAAGC<br>CGGCAAGATGCCCGAGAAAACCGTGGAAAACCTGTGCAAGAGCCTGGAAGGACAGAGAGCCCTTCGCCAATCAGCC<br>CGGCAGATTCAGAACAAGCGCCGTGGCTCTGGTCAAGTACATCTACAAGAGTTGGTTCGCCCTGCAGAAGCGGAGA<br>GCCGATAGACTGGAAGGCAAAGAACGGTGGCTGAAGATGCTGAAGTCCGACGTGGAACTGGAAAGAGAGAGCAAC<br>TGCAGCCTGGACATCATCAGAGCCAAGGCCGGCGAGATCCTGGCCAAAGTGACTGAAGGATGCGCCCCTAGCAACC<br>AGACCAGCACGAAGCGCAAGAAGAAAAAGACCAAGAAGTCCCAGGCCACCAAGGACCTGCCTACACTGTTCGAGA<br>TCATCCTGAAGGCCTACGAGCAGGCCAAGAGAGCCTGACAAGAGCCGCTCTGGCCTACCTGCTGAAGAACGATTG<br>CGAGGTGTCCGAGGTGGACGAGGACAGCGAGAAGTTCAAGAAGCGCAGACGGAAGAAAGAGATCGAGATCGAGC<br>GGCTGCGGAACCAGCTGAAGTCTAGAATCCCCAAGGGCAGAGATCTGACCGGCGACAAGTGGCTGAAAACCCTGG<br>AAGAGGCCACCAGAAACGTGCCAGAGAACAGGATGAGGGATGAGGCCAAAGCCTGGCAGGGTCAGCTGCTGAGAGAAGCCA<br>GCAGCGTGCCATTTCCTGTGGCCTACGAAACCAGCGAGGACATGACCTGGTTCACCAACGAGCAGGGCAGAATCTT<br>CGTGTACTTCAACGGCAGCGCCAAGCACAAGTTCCAGGTGTACTGCGACAGACGGCAGCTGCACTGGTTCCAGAGA<br>TTCGTGGAAGATTTCCAGATCAAGAAGAACGGGACAAGAAGGGCAGCGAGAAAGAGTATCCTGCCGGCCTGCTG<br>ACCCTGTGCAGCACAAGACTGAGATGGAAAGATTCCGCCGAGAAGGGCCACCCCTGGAATGTGCACAGACTGATC<br>CTGAGCTGCACCATCGACACCAGACTGTGGACACTGGAAGGGACCGAACAAGTGCGGGCCGAGAAAATCGCCCAG<br>GTGGAAAAGACCATCTCCAAGCGCGAGCAAGAAGTGAACCTGAGCAAGACCCAGCTGGAACGGCTGCAGGCCAAA<br>CACTCTGAGAGAGCGGCTGAACAACATCTTCCCAACAGACCCAGCAAGCCCTCCTACAGAGGCAAGAGCCACA<br>TTGCCATCGGCGTGTCCTTCAGCCTGGAAAATCCTGCCACAGTGGCCGTGGTGGACGTGGCCACAAAGAAGGTGCT<br>GACCTACAGAAGCTTCAAACAGCTGCTGGGCGACAACTACAACCTGGCCAACAGACTGCGGCAGCAGAAGCAGAG<br>ACTGAGCCACGAGAGACACAAGGCCCAGAAACAGGGCGCTCCCAACAGCTTTGGCGATTCTGAGCTGGGCCAGTAC<br>GTGGACAGACTGCTGGCCAAGAGCATCGTGGCCATTGCCAAGACATACCAGGCCAGCTCCATCGTGCTGCCCAAGC<br>TGCGGTACATGCGGGAAATCATCCACAACGAGGTGCAGGCTAAGGCCGAAAAGAAGATCCCCGGCTACAAAGAGG<br>GCCAGAAGCTACGCCAAGCAGTACAGAATCAGCGTGCCACAGTGGTCCTACAACCGGCTGAGCCAGATCCTGGA<br>AAGCCAGGCCTCACAAAAGCCGGCATCTCTATCGAGAGGGGCAGCCAAGTGATCCAGGGCAGCTCTCAAGAGCAGGC<br>TAGAGATCTGGCCCTGTTCGCCTACAACGAGAGGCAGCTGTCTCTGGGCTAA |
| TracrRNA<br>(SEQ ID<br>NO: 968) | TTATTAAAATACCGTACCTTGAAAATATCATAAGCTAATAAAGAATCAATACTTTACTACATTGTTTGACAGGCTCC<br>CAAATCCCCAAATTCTTATAAGTTGTTGGGGATTTGGTCAACCTCACCTAATATGGTAGAGTACTAATAGCGCCGCA<br>GTTCATGCTCTTTAAGAGTCTCTGTACTGTGGAAAATCTGGGTTAGTTTGACGGTTGGAAAACCGTTTTGCTTTCTGA<br>CCCTGGTAGCTGCCCGCTTCTCATGCTCTGACTTTTCACGTTATGTGGAAAAAGTAACGTAATTTCGTTAGTTAAGAC<br>TTACCGTAAAAAGTCAGTTCTGATGCTGCTGTCGCAAGACAGGATAGGTGCGCTCCCAGCAAAAGGAGTATGTCTT<br>GAAAAAGACTAGCCGTTCTAGTAACGGTGCGGATTACCGCAGTGGTGGCTACTGAATCACCCCCCTTCGTCGGGGAA<br>ACCCTCCCAAATATTTTTTTGGCAAAGCCAAGCGGGGGCAAAAACCCTGAGGTCCTGCCAAAACACGGAAGCCCTTG<br>TTATATCTTGATTTCAAAATCTAGGTTGTTAATTAATTTAGTTTTTTGGTTTTAAGATAGAGCTACTTTTACGCAGCC<br>CTTGCCAAATATGCTTGTGTAACGCTCTAAATAATAAGGGTTTTAGACGGGTAGA |
| DR<br>(SEQ ID<br>NO: 969) | GTTTCAACAACCATCCCGGCTAGGGGTGGGTTGAAAG |
| sgRNA<br>(SEQ ID<br>NO: 970) | TTATTAAAATACCGTACCTTGAAAATATCATAAGCTAATAAAGAATCAATACTTTACTACATTGTTTGACAGGCTCC<br>CAAATCCCCAAATTCTTATAAGTTGTTGGGGATTTGGTCAACCTCACCTAATATGGTAGAGTACTAATAGCGCCGCA<br>GTTCATGCTCTTTAAGAGTCTCTGTACTGTGGAAAATCTGGGTTAGTTTGACGGTTGGAAAACCGTTTTGCTTTCTGA<br>CCCTGGTAGCTGCCCGCTTCTCATGCTCTGACTTTTCACGTTATGTGGAAAAAGTAACGTAATTTCGTTAGTTAAGAC<br>TTACCGTAAAAAGTCAGTTCTGATGCTGCTGTCGCAAGACAGGATAGGTGCGCTCCCAGCAAAAGGAGTATGTCTT<br>GAAAAAGACTAGCCGTTCTAGTAACGGTGCGGATTACCGCAGTGGTGGCTACTGAATCACCCCCCTTCGTCGGGGAA<br>CCCTCCCAAATATTTTTTTGGCAAAGCCAAGCGGGGGCAAAAACCCTGAGGTCCTGCCAAAACACGGAAGCCCTTGT<br>TATATCTTGATTTCAAAATCTAGGTTGTTAATTAATTTAGTTTTTTGGTTTTAAGATAGAGCTACTTTTACGCAGCC<br>TTGCCAAATATGCTTGTGTAACGCTCTAAATAATAAGGGTTTTAGACGGGTAGAGAAATCCCGGCTAGGGGTGGGTT<br>GAAAGNNNNNNNNNNNNNNNNNNNNNNNN |
| LE<br>(SEQ ID<br>NO: 971) | TCGTTCTGCTTTCCAGAGATTGGTGGATGACTTCCCAACGACGGTAAGGGAGATAACTTTGCGTCACCCAGGTGAGT<br>GCTTGAGAGGGGGTAGCATCGAGAGGTAATGCTTGGGGTTGGTGTACATTCGCAAATTATATGTCGCAATTCGCAA<br>ATTAGTGTCGCAATTACTTCTAATAGCTGAGATCTTTATTGCGTAGGACTTACAAGCTATTTATCCATAAAACTGAGT<br>AATTTGCCTGTTTCGCAAATTAGATGTCGCAAATCCTATTTTCGCAAATTAAATGTCGTTTATTAAGATTTGCCTGTT<br>TCGCAAATTAGATGTCGCATTTTTGCCACATTAGTGCTTCTTTAGTACCTAAAGTGTTAATCAGTGGTTTTCACTCCA<br>ATGTTAGACGAAGAATTTGAGTTCACTGAGGAATTGACGCAAGCTCCAGATGTTATTGTGCTTGACAAGAGTCATTT<br>TGTGGTAGACCCATCCCAAATTATTCTGCAAACATC |
| RE<br>(SEQ ID<br>NO: 972) | GACTCTGTGCCTTTTTGGAGTGTTGTTCATGCAAAATTTGAGAATCTTGACTAGAACTGAAACTCTTGCTAAGTAAC<br>GCTTTCAACGAAAATAAACCATATAGTACAAATTTACTAAAAATCAACAAAATCAACATCCTAGGGTAAGTCTGT<br>CAATTAGTCCAGTAGCAAGACATTATGTTAGACGACATTAATTTGTTAACGTTAGTTGGAACTAATTCGACGACATT<br>AATTCGTTAACAGCGACATTAATTTGTTAATCGACACTAAATGGAGAAACAGGACGACATTAATTTGCGAAAAGTT<br>CCTATAATTGAATTGATGAGACAAACTATTCTAAACGACATTAATTTGCGAAAAACGACACAAATTTGCGAATTACG<br>ACATTTAATTTGCGAATGTACATTTGCGGTTCATTTAAGTAGGTAGTCTTTGGGCGGGAAAGGAGTAGAAAACACTA<br>TAAACTACTTAAAAGAACATAATTTAAACCGCAGCAACT |

TABLE 27-continued

| Name/<br>Organism/<br>System<br>ID (T) | | Sequences |
|---|---|---|
| AP014642/<br>Leptolyngbya<br>boryana<br>dg5/T33 | TnsB<br>(SEQ ID<br>NO: 973) | ATGCAGCTGCCCATCGAGTTCCCTGAGAGCGAACAGGTGTCCCGCGAACTGGTGGAACAGAACCAGATCGTGACCG<br>AGCTGAGCGACGAGGCCAAGCTGAAGATCGAAGTGATCCAGAGCCTGCTGGAACCCTGCGACAGAGCCACCTACG<br>GCAACAGACTGAGAGATGCCGCCACCAGACTGGGCAAGAGCGTCAGAACAGTGCAGCGGATGGTCAAGAGCTGGC<br>AAGAGGAAGGCATTGCCGGCCTGAGCAATGGCGAGAGAACAGACAAGGGCGAGCACCGGATTGAGCAAGAGTGGC<br>AGGACTTCATCATCAAGACCTACCAAGAGGGCAACAAGAACGGCAAGCGGATGACCCCTGCTCAGGTGGCCATCAG<br>AGTGAAAGTGAAGGCCCAGCAAGAGGGGATCACAAAGTACCCCAGCCACATGACCGTGTACCGGGTGCTGAATCC<br>CCTGATCCAGCGCAAGACCGAGAAGCAGAATGTGCGGAGCATCGGCTGGCAGGGCTCTAGACTGAGCCTGAAAAC<br>CAGAGATGGCAACAGCCTGTCCGTGGAATACTCCAATCAAGTGTGGCAGTGCGACCACACCAGAGCCGATATCCTG<br>CTGGTGGATCAGCACGGCGAGCTGATTGGTAGACCTTGGCTGACCACCGTGGTGGACACCTACAGCAGATGTATCG<br>TGGGCGTGAACCTGGGCTTCGATGCCCCTTCTTCTGACGTGGTGGCACTGGCCCTGAGACACGCCATTCTGCCCAAG<br>ACATACCCCGACAGATACCAGCTGAACTGCGACTGGGGCACATACGGCAAGCCCGAGCACTTCTTTACCGACGGCG<br>GCAAGGACTTCAGAAGCAACCATCTGCAGCAGATCGCCGTGCAGATTGGCTTCACCTGTCACCTGAGAAACAGACC<br>CTCTGAAGGCGGCGTGGTGGAAAGACCTTTCGGCACCCTGAACACCGAGTTCTTCAGCATCCTGCCTGGCTACACCG<br>GCAGCAACGTGCAGAAAAGACCCGAGGAAGCCGAGGAAAGCGCCAGCCTGACACTGAGAGAGCTGGAACAGTTCC<br>TCGTGCGGTACATCACCGACCGGTACAACCAGGGAATCGACGCCAGAATGGGCGACCAGACCAGGTTTCAGAGATG<br>GGAAGCTGGCCTGCTGGCCAATCCTAGCGTGCTGACAGAGCGCGAGCTGGACATCTGCCTGATGAAGCAGACCCGC<br>AGAACCGTGTACAGAGAGGGCTACCTGAGATTCGAGAACCTGATCTACCGGGGCGAGAATCTGGCCGGATATGCCG<br>GCGAAACAGTGACCCTGAGATACGAGCCCAGAGACATCACCACCGTGTTCGTGTACCACCAAGAGCAGGGCAAAG<br>AGGTGTTCCTGACCAGAGCACACGCCCAGGACCTGGAAACCGAGACAATCAGCCTGTATGAGGCCAAGGCCAGCA<br>GCCGGCGGATTAGAGATGTGGGCAAGACCATCAGCAACCGGTCCATCCTGGAAGAAGTGCGCGACAGGGATCTGTT<br>CGTGCAGAAGAAAACACGGAAAGAGCGGCAGAAGGCCGAGCAGGCCGAAGTGAAGATTGATCAGGTGCCAAGTCC<br>TCCTCAGGTGCTGCATCTGGATGAGGCCAGCCAGTTCGAGACAGAGATCGTGGAAACCCAGTGCGTGGAAATCAGC<br>GAGATCGAGGACTACGAGAAGCTGCGGGACGACTTCGGATGGTGA |
| | TnsC<br>(SEQ ID<br>NO: 974) | ATGATGGCCAACGAGGCCCAGTCTATCGCCCAGACACTTGGAAGCCTGCCTCTGACATCTGAGCTGCTGCAGGCCG<br>AGATCCACCGGCTGACAAAGAAAAGCGTGGTGTCCCTGAGCCAGGTGCAGGCCTGCACAATTGGCTGGAAGGCA<br>AGAGACAGGCCCGGCAGTCTTGTAGAGTTGTGGGCGAGAGCAGAACCGGCAAGACCCTGGCCTGTGATGCCTACAG<br>ACTGCGGCACAAGCCTACACAGCAGGCCGGAAAGCCTCCTATCGTGCCCGTGGTGTATATCCAGGTGCCACAAGAG<br>TGCGGCAGCAAAGAGTGCTGTTCCAGATCATCATCGAGCACCTGAAGTACCAGATGGTCAAGGGCACCGTGGCCGA<br>GATTCGCGAGAGAACCATGAGAGTGCTGAAAGGCTGCGGCGTGGAAATGCTGATCATCGACGAAGCCGACCGGCTGA<br>AGCCTAAGACCTTTGCCGATGTGCGGGACATCTTCGACAAGCTGGAAATCAGCGTGGTGCTCGTGGGCACCGACAG<br>ACTGGATGCCGTGATCAAGAGGGACGAACAGGTGTACAACCGGTTCCGGGCCTGCCACAGATTTGGAAAACTGGCT<br>GGCGAGGAATTCCGGCGGACAATCGAGATTTGGGACAAGCAGATCCTGAAGCTGCCCGTGGCCAGCAACCTGACAT<br>CTAAGGCCGCTCTGAAGATCCTGGGCGAGACAACAGCCGGCTACATCGGACTGCTGGACATGGTGCTGAGAGAGGC<br>CGCTATCAGAGCCCTGAAGCAGGGCAAGACCAAGATCGACCTGGAAATCCTGAAAGAGGTGTCCACCGAGTACCG<br>GTGA |
| | TniQ<br>(SEQ ID<br>NO: 975) | ATGATCGAGCACAGCGAGATCCAGCCATGGTTCTTTCACGTGGAAGCCCTGGAAGGCGAGAGCATCTCTCACTTTCT<br>GGGCAGATTCCGGCAGGCCAACGAGCTGACACCTTCTGGCGTGGGCAAGATCTCTGGACTCGGCGGAGCTATTGCC<br>AGATGGGAGAAGTTCCGGTTCAACCCCTATCCTACACAGCAGCAGTTCGAGAAGCTGAGCACCGCCACAGGCATCA<br>GCGTTGAGCAGCTGTGGAAGATGATGCCTCCTGAAGGCGTGGGAATGCAGCTGGAACCCATCAGACTGTGCGCCAG<br>CTGTTATGCCGAGCTGCCTTGTCACCAGATCCAGTGGCAGTTCAAGGACACCCAGGGATGCGAAGTGCACGGCCTG<br>AGACTGCTGAGCGAGTGCCCTAATTGCAAGGCCCGGTTTAAGCCTCCTGCCACTTGGAGCGATAGCAAGTGCCACC<br>GGTGCTTCATGCTGTTCAGCGAGATGCGGAACCGGCAGAAGACACAGCTTCAGCAGATGA |
| | Cas12k<br>(SEQ ID<br>NO: 976) | ATGAGCGTGATCACCATCCAGTGCAAGCTGGTGGCCACAGAAGAGACAAGACGGGCCCTGTGGCATCTGATGGCCG<br>AGAAACACACCCCTCTGATCAACGAGCTGCTGAAGCACATTGCCCAGGACAGCAGATTCGAGGAATGGTCCCTGAC<br>CGGCAAGCTGCCTAGACTGGTGGTGTCCGAGGCCTGCAATCAGCTGAAGCAGGACCCTCAGTTTAGCGGCCAGCCT<br>GGCAGATTCTACAGCAGCGCCATCAGCACCGTGCACCGGATCTTTCTGTCTTGGCTGGCCCTGCAGACCCGGCTGAG<br>AAATCAGATCAGCGGCCAGACAAGATGGCTGGCCATGCTGCAGAGCGACAATGAGCTGACAATCGCCAGCCAGAC<br>CGACATCAACACCCTGAGACTGAAGGCCAGCGAACTGCTGACCCACCTGAACGAGCCTATCAGCGAGAGCGACCAG<br>CCTGAAGTGAAGAAAACCCGGTCCAAGAAGAAGAACCAGACCAGCAATCAGGCTGGCGCCAACGTGTCCCGGACA<br>CTGTTCAAGCTGTACGACGAGACAGAGGACCCTCTGACCAGATGCGCCATTGCCTACTGCTGAAGAACGGCTGCA<br>AACTGCCCGACCAGAACGAGAACCCCGAGAAGTTCATCAAGCGGCGGAGAAAGACCGAGATCGGCTGGAAAGAC<br>TGATGAACACCTTCCAGACCACACGGATCCCCAGAGGCAGACACCTGAGCTGGCACTCTTGGATCGAGGCCCTGGA<br>AACCGCCACCTCTCACATCCCCGAGAACGAGGAAGAAGCTGCTGGCTGGCAAGCCCGGCTGCTGACAAAACCTGCC<br>ATCCTGCCTTTTCCAGTGAACTACGAGACAAACGAGGACCTGCGGTGGTTCACTGAACAGCCAGCAGGGCAGAATCTGTG<br>TGTCCTTCAACGGCCTGAGCGAGCACTTCTTCGAGGTGTACTGCGACCAGAGGGACCTGCACTGGTTCAACCGGTTT<br>CTGGAAGATCAAGAGACAAAGAAGGCCTCCAAGAACCAGCACAGCAGCAGCCTGTTCAGCCTGAGATCTGGACAG<br>ATCGCCTGGCAAGAAGGCAAGGGCGACGCCGAACATTGGGTCGTGCATAGGCTGGTGCTGAGCTGCAGCATCGAGA<br>CAGACACATGGACCCAAGAGGGCACCGAGGAAATCCGGCAGAAGAAAGCCAGCGACTGCGCCAAAGTGATCGCCA<br>GCACAAAGGCCAAAGAGAACAGAAGCCAGAACCAGGACGCCTTCATCCGGCGAGAGAACGGATGCTGGAACTGC<br>TGGAAAATCAGTTCCCCAGACCTAGCTACCCACTGTACCAGGGACAGCCTTCTATCCTGGCCGGCGTGTCCTATGGC<br>CTGGATAACCTGCCACACTGGCCATCGTGAACATCCAGACAGGCAAGGCCATCACCTACCGGTCCATCAGACAGA<br>TCCTGGGGAAGAACTACAAGCTGCTCAACCGGTACAGACTGAACCAGCAGCGGAACGCCCACAAGCGGCACAACA<br>ACCAGAGAAAAGGCGGCAGCAGCAGCTGAGAGAGTCCAATCAGGGCAGTACCTGGACAGGCTGATCGCCCACG<br>AGATCGTGGCCATTGCTCAAGAGTACCAGGTGTCCTCTCTGGCTCTGCCCGATCTGGGCGACATCAGAGAAATCGTG<br>CAGTCCGAGGTGCAGGCCAGAGCCGAGCAAAAGATTCTGGGCTCCATCGAGCAGCAGAGGAAGTACGCCAGACAG<br>TACAGAGCCAGCGTGCACCGTTGGAGATACGCCCAGCTGACCCAGTTCATCCAGAGCCAGGCTGCCCAAGTGGGCA<br>TCTCTATCGAGATCACCAAGCAGCCCCTGAGCGGCACCCCTCAAGAGAAGGCTAGAAACCTGGCTATCGCCGCCTA<br>CCAGAGCCGGAAATGA |

TABLE 27-continued

| Name/<br>Organism/<br>System<br>ID (T) | | Sequences |
|---|---|---|
| | TracrRNA<br>(SEQ ID<br>NO: 977) | AAATTACTTGCAATTAGTTCAAATGTATTTTATAAATAGAGTGCGCCGTGGTTCATGCTAGCAATAGCCCCTGTGCC<br>ATCGACAATTACGAGCTAGTTTGACTGTCGGAAGATAGTCTTGCTTTCTGGCTCAGGTTGACTGTCTACCTCGAAGTT<br>GGGTGCGCTCCCAGCAAAAGGGTGCGGGTCTACCGCAATGCTGGTTAGCCAATCTCACCTCCGAGCAAGGAGGAAT<br>CCACCCCTAACTTTTAACTTGTTGGCAAACCGAAGCGAGGTCAAAATCCCTAGGAGGTTTGCCAATCCGTACAAACT<br>AATCCCTTCAGCAGCTTTCCACAGCATAAAGCTGCTTCTTGTCCAACAAAAAGTATCGGATTTAGAGGGGTTTGCCA<br>AAACCATGTTTGAAAAGCACACTATGGCTGCACCTTGAATGGCAGG |
| | DR<br>(SEQ ID<br>NO: 978) | GTTTCATCCAGGTTTGCGGCAAGGGGGCGATTGAAAG |
| | sgRNA<br>(SEQ ID<br>NO: 979) | AAATTACTTGCAATTAGTTCAAATGTATTTTATAAATAGAGTGCGCCGTGGTTCATGCTAGCAATAGCCCCTGTGCC<br>ATCGACAATTACGAGCTAGTTTGACTGTCGGAAGATAGTCTTGCTTTCTGGCTCAGGTTGACTGTCTACCTCGAAGTT<br>GGGTGCGCTCCCAGCAAAAGGGTGCGGGTCTACCGCAATGCTGGTTAGCCAATCTCACCTCCGAGCAAGGAGGAAT<br>CCACCCCTAACTTTTAACTTGTTGGCAAACCGAAGCGAGGTCAAAATCCCTAGGAGGTTTGCCAATCCGTACAAACT<br>AATCCCTTCAGCAGCTTTCCACAGCATAAAGCTGCTTCTTGTCCAACAAAAAGTATCGGATTTAGAGGGGTTTGCCA<br>AAACCATGTTTGAAAAGCACACTATGGCTGCACCTTGAATGGCAGGGAAATTGCGGCAAGGGGGCGATTGAAAGN<br>NNNNNNNNNNNNNNNNNNNNN |
| | LE<br>(SEQ ID<br>NO: 980) | TTTAGGAGCGTTCTCAAATTTCACAACTCAAATCGGATTGCTCTATGTGTAGATTGAAAGAACAGCAAATTGCTAGC<br>AGAATAAAGTGTTATTCGACAATTGTTGTCGAATAACACTTTAAATGTCGTCATAACGAATTGATGTCGTTCAGCCT<br>CAACAACTTAAACTTCCTATTAATATTGACTTTCAGCTCTTTCAGAGCGATCGCGCCCTTGCAGGACGATTAACATTA<br>TCCATGTCGCTTTTCAGAGTAGTAACAAATTCAGTGTCGTGTTTTACGATCAGGGGTTTAACACAATCAGCGTCATG<br>ATTTTGAGATCTCAATAGATGACAACCAGCAAAAGGCAACCTGACTTCAAAATCTACAATCAGACCACAATCAAG<br>GTGCGATCGCGGCAAGATTCCCATAAACCTCAGTTTCCGCATAGTGTTTAGAAAAAATCTGCTTGAAAATCTATTTA<br>GCTAGAAACCCAGAAATTCTAGCTAAATAAGAATTACT |
| | RE<br>(SEQ ID<br>NO: 981) | GGTTTGCGGCAAGGGGGCGATTGAAGAGTAACTTAGTCTTTTGACAACTTTAATAGGCACAATCTTTCGGTTAACAG<br>TGGGTGGATTGAAAGGACTGCCTGACTCGGGGTTTTAATTTAGAAATATTTGCCCCTCGCTATAACGAGCAGAGTTA<br>GCATTCGTTTTAACTGGGTAGAGTCTGTACTGTAAAATGTTGAAGTGGATAAGAATTTGAATGAGCATTCAACTGCT<br>TGAAGCTCTGATGACAAGAATTTGTTAACGAATGATTTCTTACCCCTCGACGACAAGAAGCTGTTAAAACGACACTA<br>AATTGTTAACGACGACATCAATCCGTTAACGACGACAAATAAAGTGTTATTCGACAACAATCACACGAATTTAAAC<br>AAAAAATTGCCTGACTCTTAAAAGCCCCCAGAGTCAGGCAGTCTACCTGTAAGGCACGCCTTTAACCGGATACACC<br>AAACAAACTTAGTTGCCCCCTAGTTGCTTAGCTTTTCCGA |
| AP014821/<br>Geminocystis<br>sp.<br>NIES-3709/<br>T34 | TnsB<br>(SEQ ID<br>NO: 982) | ATGACCATCGAGAACCAGATCAGCGAGAGCCAAGAGCTGATCTCCCAGCTGAGCCCTGAGGAACAGGCCATTGCCG<br>ACGTGATCGAGGATCTGGTCAGCCCTGCGACAGAAAGACATACGGCGCCAAGCTGAAGAAGGCCGCCGAGACAC<br>TGAACAAGAGCGTGCGAACCGTGCAGCGGTACATCAAAGAGTGGGAAGAGAAGGGCCTGCTGGCCATCAAGAAGG<br>GCAACAAGGGCAGCAAGAGAATCAGCCCCAAACAGGTGTACCTGCGCAATGCCCAGGCCAAAGAATGGTCCA<br>TCGATCCTCCAAGCCACATGACCGTGTACCGGATTCTGAACCCCATCATCGAGGAAAAAGAAAACAAGAAACGCGT<br>GCGGAACCCCGGCTGGCGGGGAACAAAACTGGCTGTGTCTACCAGAAGCGGCAACGAGATCAACGTGGAATACTC<br>CAACCACGCCTGGCAGTGCGATCACACCAGAGCCGATATCCTGCTGGTGGACCAGTTTGGCCAACTGCTGGGTAGA<br>CCTTGGCTGACCACAGTGGTGGACACCTACAGCAGATGCATCATGGGCATCAACCTGGGCTTCGACGCCCTAGCTC<br>TCAGGTTGTGTCTCTGGCCCTGAGACACGCCATGCTGCTGAAGTCCTACAGCTCCGATTACGGCCTGCACGAGGAAT<br>GGGGCACATACGGCAAGCCCGAGTACTTCTACACCGACGCGGCAAGGACTTCCGGTCCAATCATCTGCAGCAGAT<br>CGGCCTGCAGCTGGGCTTCACATGCCACCTGAGAAGCAGACCTAGCGAAGGCGGCGTGGTGGAAAGACCCCTTCAAG<br>ACCCTGAACACAGAGGTGTTCAGCACCCTGCCTGGCTACACAGGCGGCAACGTGCAAGAGAGATCTGAGGACGCCG<br>AGAAGGACGCCAGCCTGACACTGAGACAGCTGGAAAGAATCATCGTGCGCTACATCGTGGACAACTACAACCAGC<br>GGATGGACCCAGAATGGGCGAGCAGACCAGATTCCAGAGATGGGATAGCGGCCTGCTGAGCATCCCTGATCTGCT<br>GAGCGAACGCGACCTGGACATCTGCCTGATGAAGCAGTCTAGACGGCGGGTGCAGAAAGGCGGCTACCTGCAGTTC<br>GAGAACCTGATGTACCAGGCGAGTACCTGGCCGGCTATGAGGGCGAGACAGTGATCCTGAGATACGACCCCAGA<br>GACATCACCGCCATCCTGGTGTACAGAAACGAAGGCAACAAAGAAGTGTTCCTGACCAGAGCCTACGCCTGGACC<br>TGGAAACAGAGAGCATGAGCTGGGAAGATGCCAAGGCCAGCGCCAAGAAAGTGCGCGAGTCTGGCAAGAACCTGA<br>GCAACAGATCCATCCTGGCCGAAGTGAAAGAGCGGCACCGTTCAGCGACAAAAAGACCAAGAAAGAGGCCGC<br>GGCAAGAGCAAGAACAAGTGAAGCCTTATATTCCATCTCCGGTGCTGAAAGAAGTCAAAGAGCAGACCGACAAGG<br>CCACCGACACCGACATGAGCGAGGAACCCATCGTGGAAGTGTTCGACTACAGCCAGCTCCAGGACGACTACGGCTT<br>CTGA |
| | TnsC<br>(SEQ ID<br>NO: 983) | ATGGAAGCCAAGGCTATCGCCCAAGAGCTGGGCAACATCGAGATCCCCGAAGAGAAGCTGCAGATGGGAAATCGAG<br>CGGCTGAACAGCAAGACCCTGGTGTCCCTGGAAGGTGGCCAGCGTGACTACTTCGAGGGCAAGACAG<br>AGCAAGCAGAGCTGCAGAGTCGTGGGCGAGAGCAGAACCGGAAAGACCATGGCCTGCGACAGCTACCGGCTGAGA<br>CACAAGCCCATCCAGAAAGTGGGACACCCTCCTCAGGTGCCCGTGGTGTACATCCAGATTCCTCAGGACTGCGGCA<br>CCAAAGAGCTGTTTCAGGGCATCATCGAGTACCTGAAGTACCAGATGACCAAGGGCACAATCGCCGAGATCAGACA<br>GCGGGCCATCAAGGTGTTGCAAGGCTGCGGCGTGGAAATGATCATCATCGACGAGGCCGACCGGTTCAAGCCCAAG<br>ACCTTTGCTGAAGTGCGGCAACATCTTCGACAGATCGAACATCCCATCGTGCTCGTGGGCACCAATGACTGGACAC<br>CGTGATCAAGCGGGACGAACAGGTGTACACCGGTTCAGAAGCTGCTACAGATTCGGCAAGCTGTCTGGCGCCGAC<br>TTCCAGAACACCGTGAACATCTGGGAGAAACAGGTGCTGAAGCTGCCCGTGGCCAGCAACCTGATCCAGACCAAGA<br>TGCTGAAACTGATCGCCGAGGCCACAGGCGGCTATATCGGCCTGATGGACACCATCCTGAGAGAGAGCGCCATCAG<br>AAGCCTGAAGCGGGGCCTGAACAAGATCACCTTCGAGATCCTGAAAGAAGTGACCCAAGAGTTCAAGTGA |
| | TniQ<br>(SEQ ID<br>NO: 984) | ATGGAACTGTCCAGATCCAGAACTGGCTGTTCATCCTGGTGCCTTACGAGGGCGAGAGCATCAGCCACTTTCTGGGCAG<br>ATTCAGACGGCCAACAGCCTGTCTTGTGCGGACTGGGACAAGCCACAGGACTGTACTCTGCCATTGCCAGATGG<br>GAGAAGTTCCGGTTCAACCCCTCCACCTAGCCTGAAGCAGCTGGAAAAGCTGAGCGAGATCGTCAGGTCGAGATGG<br>CCACACTGCAGACCATGTTTCCCAGCGCTCCCATGAAGATGACCCCTATCGAATCTGCAGCGCCTGCTACGCGAG<br>AACCCCTACCATCAGATGAGCTGGCAGTACAAAGAAATCTACAGATGCGACCGGCACAACCTGAACATCCTGAGCG<br>AGTGCCCTAACTGCGCCGCCAGATTCAAGTTCCCCAACCTTTGGTTCGAGGGCTTCTGCCACAGATGCTTCACCCCTT<br>TCGAGCAGATGCCCCAGAGCTGA |

TABLE 27-continued

| Name/<br>Organism/<br>System<br>ID (T) | | Sequences |
|---|---|---|
| | Cas12k<br>(SEQ ID<br>NO: 985) | ATGGCCCACGTGACCATCCAGTGTAGACTGATCGCCAGCCGGGATACCAGACAGTTCCTGTGGCAGCTGATGGCCC<br>AGAAGAACACCCCTCTGATCAACGAGATCCTGCTGCGGATCAAGCAGCACCCCGATTTTCCCCACTGGCGGACCAA<br>GAAGGACTTCCTGGCCAGACAGATCGCCGAGCTGAAGAACAACTACCCCTTCGAGGAACAGCCC<br>AGCCGGTTTTACGCCAGCGTGAACAAAGTGATCGACTACATCTACAAGAGTTGGTTCGAGGTGCAGAAGGCCCTGG<br>ACTGGAAGCTGCAGGGCAATCTGAGATGGGTCGAAATGCTGCTGCCCGACACCGAGCTGATCAAGCACTTCGACAA<br>CAGCCTGGAAAGCCTGCAGCAGCAGGCCACACTGATCCTGGACAGCATCGACAGCACCGTGTCTCACGACCGGATC<br>AGCACCATCCTGTTCGAGAAGTGCGGCAAGACAAAGAAGCCCGAGATCAAGAGCGCCATCATCTACCTGCTGAAGA<br>ATGGCTGCACAATCCCCAAGAAGCCTGAGACAACCGAGAAGTACCAGGACCTGAAGCGGAAGGTGGAAATCAAGA<br>TCACCAAGCTGCACCGGCAGATCGAGAGCAGAATCCCTCTGGGCAGAGATCTCGAGGACAAGAAGTGGCTGGACA<br>CCCTGATCACCGCCAGCACAACAGCCCCTATCGATCAGACCGAGGCCAACACCTGGTTCAGCATCCTGAAGCAGAA<br>CCAGAGCAGCATCCCCTATCCTGTACGAGACAAACGAGGATCTGAAGTGGTCCCTGAACGAGAAGAACCGG<br>CTGAGCATCAGATTCAGCGGCCTGGGCGAGCACAGCCAGCCCTTTCAGCTGTGTTGCGACCACAGACAGCTGCCCTACTTCCA<br>GCGGTTCTACGAGGACCAAGAGCTGAAAAAGGCCAGCAAGGACCAGCTGAGCAGCGCCCTGTTTACACTGAGAAG<br>CGCCATGATCCTGTGGAAAGAGGACGAAGGCAAGGGCGAGCTGTGGGACAGACACAAGCTGTACCTGCACTGCAC<br>CTTCGAGACAAGATGCCTGACAGCCGAGGGCACCTCCACCATCGTGGAAGAGAAGCAGAAAGAAGTGACCAAGAT<br>CATCGACCTCATGAAGGCCAAAGAGGAACTGAGCGACAGCCAGCAGGCCTTCATCAGACGGAAGAATAGCACCCT<br>GGCCAAGCTGAACAACACATTCCCCAGACCTAGCAAGCCCGTGTACCAGGGCAAGCCCAATGTGCACCTGGGAATC<br>GCCATGGGACTCGAGCAGCCTGTGACAATCGCCATTGTGGACATCGAAACCGACAAAGTCATCACCTACCGGAACA<br>CCAAACAGCTGCTGAGAGAGGACTACCGCCTGCTGAAGAAGGCGGATCGAGAAACAGAAGCTGAGCCACCAGA<br>ACCACAAGGCCCGGAAGCGGTTCAACTTCCAGCAGAAGGGCGAGAGCAATCTGGGCGAGTACCTGGATCGGCTGAT<br>TGCCAAGGCCATCCTGACAGTGGCCCAAGAGTACCAGGTGTCCACCATTCTGATCCCCAGACTGAGAGACATGCGG<br>AGCATCACCGAGGCCGAGATTCAGCTGAGAGCCGAGAAGAAGATCCCCGAGTACAAAGAGGGCCAGAAGAAGTAC<br>GCCCAGGACTACAGAGTGCAGGTCCACCAGTGGTCCTACGGCCGCCTGATCGAGAACGTGAAGCTGATCTGCGAGA<br>AGTGGGCATCGTGGTGGTGGAAGCCAAGCAGCCTAAGCAGGGAACCCTGACCGAAAAGGCTCTGCAGCTGGTGCT<br>GAGCGCCACCGAGAAAAACCTGAAGAAGAAGTGA |
| | TracrRNA<br>(SEQ ID<br>NO: 986) | CACAAAATCAATTTCTTGAGATAAACTGGAAGTAATCGTGCCGCAGATCAAGTTAAATTAACCCCTGTTCTGTTGTT<br>CTGTGAAAAATGAGGGGTAGTTTGCCTAGTAATAGGTTTGCTTTCGTCCCTGATAACTGCTCTCTCTGATGCTGCGC<br>ACTGAATAAAGTGCGGAAACAAGGGGCACTCCCAGTAATAAGAGTTTGGGTTTACCAGTAGTTGTTATCAAATC<br>ACCTCCGACCAAGGAGGAATCTCTATTTAAGCGTTAGTTAAAATGTACGAGTTACACAAACTCTGATTTTAGCCTTA<br>CGCAATCGCTAAAACTCTTATCAATTAAGGGATATAGCGTTTTAATAAAATGCAAATTCGATCGAAAATCAGAATT<br>TTAGTATTTTAAGGGGGCTTACGCAAACTGTCTTCACAAGCCTTGTTTTATAAGGTTTCTGACTAGGGGCA<br>GTTGAAATAAGAAAATACCTTCTCTAGGGATTGAAAG |
| | DR<br>(SEQ ID<br>NO: 987) | |
| | sgRNA<br>(SEQ ID<br>NO: 988) | CACAAAATCAATTTCTTGAGATAAACTGGAAGTAATCGTGCCGCAGATCAAGTTAAATTAACCCCTGTTCTGTTGTT<br>CTGTGAAAAATGAGGGGTAGTTTGCCTAGTAATAGGTTTGCTTTCGTCCCTGATAACTGCTCTCTCTGATGCTGCGC<br>ACTGAATAAAGTGCGGAAACAAGGGGCACTCCCAGTAATAAGAGTTTGGGTTTACCAGTAGTTGTTATCAAATC<br>ACCTCCGACCAAGGAGGAATCTCTATTTAAGCGTTAGTTAAAATGTACGAGTTACACAAACTCTGATTTTAGCCTTA<br>CGCAATCGCTAAAACTCTTATCAATTAAGGGATATAGCGTTTTAATAAAATGCAAATTCGATCGAAAATCAGAATT<br>TTAGTATTTTAAGGGGGCTTACGCAAACTGTCTTCACAAGCCTTGTTTTATAAGGTTTCTGACTAGGGGCAGAAA<br>AATACCTTCTCTAGGGATTGAAAGNNNNNNNNNNNNNNNNNNNNNNN |
| | LE<br>(SEQ ID<br>NO: 989) | AGAAAGTGGACGAGAAGCTCTATTTTGCTATCCTTGTTTTAATTTTGGCAGTAATTGTTTGACTACTTATTAAAATAA<br>AATTGATGGAAAAGTTAAAAATCAGTCTGAAAATGCTTTTGAATAACTTTGATAAAAAATCTTGTACAGTAACAGAT<br>TATTTGTCGTGATAACAAATTCGTGTCATCTAAAAATAAGACTCTTAAAATCCTTATATATCAACAATTATAACTTAT<br>CCTTACCCTAAAATCACACTCGATTGTATCTTAAAATAGATTAACAAATTAAGTGTCATTTTCCCTAAAAATAACAA<br>ATTAGATGTCGCCTTCGGAAAAGGCGATTTTTTTTGTTTTTGAGTGGCAATTCACAGATTAAATGTCATGAATAAT<br>AAGTACACATCAACTTTGATTTTATTAAACATAAAATATCAGCTATGACTATTGAAAATCAAATTTCTGAATCTCA<br>GGAACTGATTTCTCAACTTTCTCCCGAAGAACAGGC |
| | RE<br>(SEQ ID<br>NO: 990) | GCTTTTTATTTTGAACTAAAACTCTACTAATTAGAATCTGTCATCGAGACGAAACAAAACGATCATATTTTCTTTTTAA<br>AGTTATAATTTCAATAGTGCCGTAGATCAAGTTTTAACAACCTCTGTTCTATGAAAAATGAGGAGTAGTTTACTTTTT<br>ACAAGAAGTTTGCTTTCGGCTCCTGCTAACTACTTGCCCTGATGCTGTCTATCTTAGGATAGAGAAACTAGGCGCAC<br>TCCCAGCAATAAGGGTGCAGGTGTACTGCTATAGCGGTTAGCAAATCACTTTCGATCGAGGAAGAATTCTCTTTGAG<br>AATTGAAAGCGAGTCCTGTCGCACCCAATCATTTAGACGACATTAATCTGTTATCACGTCATCTAATTTGTTAAGAC<br>GACACTAATCTGTTACCGATGACAAATAATTTGTTACTGTACATCAATTTAAAATACGAGCCAACGGCTAAGTAATA<br>CACGGGTGCGACAGGACTCGAACCTGTGACCGACTG |
| AP017295/<br>Nostoc sp.<br>NIES-3756/<br>T35 | TnsB<br>(SEQ ID<br>NO: 991) | ATGCCCGACAAAGAGTTTGGACTGACCGGCGAGCTGACCCAGATTACCGAGGCCATCTTTCTGAGCGAGAGCAACT<br>TCGTGGTGGACCCTCTGCACATCATCCTGGAAAGCAGCGACAGCCAGAAGCTGAAGTTCAACCTGATCCAGTGGCT<br>GGCCGAGTCTCCCAACAGACAGATCAAGAGCCAGCGGAAGCAGGCCGTGGCTGATACACTGGGAGTGTCCACCAG<br>ACAGGTGGAACGGCTGCTGAAAGAGTACAACGGCGACCGGCTGAATGAGACAGCTGGCGTGCAGAGATGCGACAA<br>GGGCAAGCACAGAGTGTCCGAGTACTGGCAGCAGTACATCAAGACCATCTACGAGAACAGCCTGAAAGAAAGCA<br>CCCTATGAGCCCGCCAGCGTCGTGCGGAAGTGAAAAGACCACCATCGTGGATCTGGGCCCTCGAGCACGGCGAT<br>TATCCTCATCCTGCCACCGTGTACCGGATCCTGATCCTCTGATCGAGCAGCAGAAGCGAAGAAGAAGATCAGAA<br>ACCCCGGCAGCGGCAGCTGGCTGACCGTGGAAAAAGAGATGGCAAGCAGCTGAAGGCCGAGTTCAGCAACCAGA<br>TCATCCAGTGCGACCACACCGAGCTGGACATCAGAATCGTGGACAGCAACGGCGTGCTGCTGCCCAAAGACCTTG<br>GCTGACAACCGTGGTGGATACCTTCAGCAGCTGCGTGCTTGGTGCTTCACCTGTGGATCAAGCAGCCTGGAAGCGCC<br>GAAGTTGCCCTGGCTCTGAGACACAGCATCCTGCCTAAGCAGTACCCTCACGACTACGAGCTGAGCAAGCCTTGGG<br>GCTACGGCCCTCATTCCAGTACTTTTTCACCGACGGCGGCAAGGACTTCAGATCCAAGCACCTGAAAGCCATCGGC<br>AAGAAACTGCGGTTTCAGTGCGAGCTGCGGGACAGACCTAATCAAGGCGGCATCGTGGAACGGATCTTTAAGACCA<br>TCAACACCCAGGTGCTGAAGGACCTGCCTGCTGCTACACAGGCAACGTGCAAGAGGCCACAGGCGCTGAGAACGCCGAA<br>AAGAGGCCTGTCTGGGCATCCAGGACATCGACAAGATCCTGGCCAGCTTCTTCTGCGACATCTACAACCACGAGCC<br>GTATCCTAAGGACCCAGAGAGACAAGATTCGAGCGGTGGTTCAAAGGCATGGGCGGCAAGTGCCTGAGCCTCTG<br>GATGAGAGAGCTGGATATCTGCCTGATGAAAGAAACCCAGAGAGTGGTGCAGGCCCACGGCAGCATCCAGTTC<br>GAGAACCTGATCTACAGAGGCGAGAGCCTGAGAGCCTACAAGGGCGAGTACGTGACCCTGAGATACGACCCCGAC<br>CACATCCTGACACTGTACGTGTACAGCTGCGACGCCAACGACGATATCGGCGACTTTCTGGGCTATGTGCACGCCGT |

TABLE 27-continued

| Name/Organism/System ID (T) | Sequences |
|---|---|
| | GAACATGGACACCCAAGAGCTGTCCATCGAGGAACTGAAGTCCCTGAACAAAGAGCGGAGCAAGGCCAGAAGAGA<br>GCACAGCAATTACGACGCCCTGCTGGCCCTGGGCAAGAGAAAAGAGCTGGTCAAAGAGCGCAAGCAAGAGAAGAA<br>AGAGCGGCGGCAGGCCGAGCAGAAGAGACTGAGAAGCGGCAGCAAGAAAAACTCCAACGTGGTGGAACTGAGAA<br>AGAGCCGGGCCAAGAACTACGTGAAGAACGACGACCCCATCGAGGTGCTGCCAGAGAGAGTGTCCCGGGAAGAGA<br>TCCAGGTGCCAAAGACCGAGGTGCAGATCGAGGTGTCCGAGCAGGCCGACAACCTGAAGCAAGAAAGACACCAGC<br>TCGTGATCAGCAGACGGAAGCAGAACCTGAAGAACATCTGGTGA |
| TnsC (SEQ ID NO: 992) | ATGGCCCAGAGCCAGCTGGTCATCCAGCCTAACGTGGAAACACTGGCCCCTCAGCTGGAACTGAACAATCAGCTGG<br>CCAAGGTGGTGGAAATCGAGGAAATCTTCAGCAACTGCTTCATCCCCACCGACCGGGCCTGCGAGTACTTCAGATG<br>GCTGGACGAGCTGCGGATCCTGAAGCAGTGTGGCAGAGTTGTGGGCCCCAGAGATGTGGGCAAGAGCAGAGCCTCT<br>GTGCACTACAGAAGAGGACCGGAAGAAAGTGTCCTACGTCAGAGCTTGGAGCGCCAGCAGCAGCAAGAGACTG<br>TTCAGCCAGATTCTGAAGGACATCAACCACGCCGCTCCTACCGGCAAGAGAGGATCTCAGACCTAGACTGGCCG<br>GCAGCCTGGAACTGTTCGGAATCGAGCAAGTGATCGTGGACAACGCCGACAACCTGCAGAGAGAGGCACTGCTGG<br>ACCTCAAGCAGCTGTTCGACGAGAGCAACGTGTCCGTGGTGCTCGTTGGAGGCCAAGAGCTGGACAAGATCCTGCA<br>CGACTGCGACCTGCTGACCAGCTTTCCCACACTGTACGAGTTCGACACCCTGGAAGATGACGACTTCAAGAAACC<br>CTGAGCACCATCGAGTTCGATGTGCTGGCACTGCCCCAGGCCTCTAATCTGTGTGAAGGCATCACCTTCGAGATCCT<br>GGTGCAGAGCACAGGCGGCAGAATCGGCCTGCTGGTTAAGATCCTGACCAAGGCCGTGCTGCACAGCCTGAAGAAT<br>GGCTTCGGCAGAGTGGACCAGAACATCCTGGAAAAGATCGCCAACAGATACGGCAAGCGGTACATCCCTCCTGAGA<br>ACCGGAACAAGAACAGCTGA |
| TniQ (SEQ ID NO: 993) | ATGGAAAAGGACACGTTCCCTCCAAAGACCGAGATCAGAATCCACGACAACCACGAGGCCCTGCCTAGACTGGGCT<br>ACGTGGAACCTTATGAGGGCGAGAGCATCAGCCACTACCTGGGCAGACTGCGGAGATTCAAGGCCAACAGCCTGCC<br>TAGCGGCTACAGCCTGGGGAAAGATCGCCGGAATTGGCGCCGTGACCACAGATGGGAAGCTGTACTTCAACCCA<br>TTTCCTAGCAGCCAGGAACTGGAAGCCCTGGGCAAGCTGATTGGCGTGCCAGCCAACCGGATCTACGAGATGTTGC<br>CTCCTAAGGGCGTGACCATGAAGCCCAGACCTATCAGACTGTGCGCCGCCTGTTATGCCGAGGTGCCCTGTCACAGA<br>ATCGAGTGGCAGTACAAGGACAAGCTGAAGTGCAACCACCACAACCTGGGCCTGCTGACCAAGTGCACCAACTGCG<br>AGACACCCTTTCCTATACCTGCCGACTGGGTGCAGGGCGAGTGCCCTCACTGTTTTCTGCCCTTTGCCAAGATGGCC<br>AAGCGGCAGAAACCCCGGTAA |
| Cas12k (SEQ ID NO: 994) | ATGAGCGTGATCACCATCCAGTGCAGACTGGTGGCCGAAGAGGACACCCTGAGACAAGTGTGGGAGCTGATGACCG<br>ACAAGAACACCCCTCTGGTCAACGAGCTGCTGGCCCAAGTGGGAAAGCACCCCGAGTTTGAGACATGGCTGGAAAA<br>GGGCAAGATCCCCACCGAGTTTCTGAAAAACCCTGGTCAACAGCCTGAAGAATCAAGAGCGGTTCAGCGACCAGCCT<br>GGCCGGTTTTACACAAGCGCCATTGCTCTGGTGGACTACGTGTACAAGAGTTGGTTCGCCCTGCAGAAGCGGCGGA<br>AGAGACAGATCGAGGGCAAAGAGCGGTGGCTGATCATCCTGAAGTCCGACCTGCAGCTGGAACAAGAGTCCCAGT<br>GCAGCCTGAACGTGATCAGAACCGAGGCCAACGAGATCCTGGCCAAGTTCACCCCTCAGAGCGACCGACGAACAAGA<br>ACCAGAGAAAGAGCAAGCGGACCAGAAAGAGCGCCAAGCTGCAGACCCCCTAGCCTGTTCCAGAACCTGCTGAACA<br>CCTACGAGCAGACCCAAGAGACACTGACCAGATGCGCTATCGCCTATCTGCTGAAGACAACTGCCAGATCAGCGA<br>GAGAGATGAGGACCCCGAGGAATTCAACCGGAACAGACGGAAGAAAGAGATTGAGATCGAGCGGCTGAAGGATCA<br>GCTGCAGAGCAGAATCCCCAAGGGCAGAGATCTGACCGGCGAGGAATGGCTGAAAACACTGGAAATCGCCACCAC<br>CAACGTGCCCCAGACAGAGAATGAAGCCAAGGCCTGCAAGCCGCTCTGCTGAGAAAACCTGCCGACGTGCCATTT<br>CCTGTGGCCTACGAGAGCAACGAGGACATGACCTGGCTGCAGAACGATAAGGGCAGACTGTTCGTGCGGTTCAACG<br>GCCTGGGCAAGCTGACCTTCGAGATCTACTGCGACAAGCGGCATCTGCACTACTTCAAGCGGTTTCTCGAGGACCAA<br>GAGCTGAAGCGGAACAGCAAGAATCAGCACAGCAGCAGCCTGTTCACACTGCGGAGCGGAAGAATCGCTTGGAGC<br>CTGGGAGAAGAGAAGGGCGAGCCCTGGAAAGTGAACAAGCTGCACCTGTACTGCACCCTGGACACCCGGATGTGG<br>ACCATCGAGGGAACACAGCAGGTCGTGTCCGAGAAAGAACCACCAAGATCACCGAGACTCTGAACCAGGCCAAGCGG<br>AAGGACGTGCTGAACGACAAGCAGCAGGCCTTCGTGACCAGACAGCAGAGACACTGGACCGGATCAACAACCCA<br>TTTCCTCGGCCTAGCAAGCCCAACTACCAGGGCCAGCCTTCTATCCTCGTGGGCGTGTCCTTTGGCCTGGAAAAGCC<br>TGTGACACTGGCCGTGGTGGACGTGATCAAGAATGAGGTGCTGGCCTACCGGACCGTGAAACAGCTGCTGGGCAAG<br>AACTACAACCTGCTCAACCGGCAGCGGCAGCAGCAACAGAGACTGTCTCACGAGAGACACAAGGTGCAGAAGAGA<br>AACGCCCCTAACGACCTTCGGCGAGTCTGAGCTGGGCCAGTACGTTGACAGACTGCTGGCTGACGCCCATCATTGCCAT<br>TGCCAAGACATACCAGGCCGGCAGCATCGTGATCCCCAAGCTGAGAGACATGAGAGAGCAGATCAGCTCCGAGATC<br>CAGAGCAGAGCCGAGAAGAAGTGCCCCGGCTACAAAGAGGTGCAGCAGAAGTACGCCAAAGAATACCGGATGAGC<br>GTGCACAGATGGGGCTACGGCAGACTGATCGAGAGCATCAAAAGCCAGGCCGCCAAGGCCGGAATCTTCACCGAG<br>ATTGGCACCCAGCCTATCCGGGGCTCTCCTCAAGAGAAGGCTAGAGATCTGGCCGTGTTCGCCTACCAAGAGAGAC<br>AGGCCGCTCTGATCTGA |
| TracrRNA (SEQ ID NO: 995) | TTCACTAATCTGAACCTTGAAAATATAATATTTGTATAACAGCGCCGCAGTTCATGCTCTTTTGAGCCAATGTACTGT<br>GATAAATCTGGGTTAGTTTGGCAGTTGGAAGACTGTTATGCTTTCTGACCCTGGTAGCTGCCCGCTTCTGATGCTGCC<br>ATCTGTAGACTTCTATAGATGGGATAGGTGCGCTCCCAGCAATAAGGAGTAAAGCTTTTAGCTGTAACCGTTATTTA<br>TAACGGTGTGGATTACCACAGTGGTGGCTACTGAATCACCCCCTTCGTCGGGGGAACCCTCCCAAATATTTTTTGG<br>CGAATCGAAGCGGGGTCAAAATCCCTGGGGACTTGCCAAACTCTGAAAACCCTTGTCCTGTATTGAATCAAAGAAT<br>CATTTTGTAAATTGATTTACTATTTTGATTTTCAGCACAAGCAGCTTTTTCAGGGACGTGTCAATTAGACATCTGAAA<br>AGCTTGTATAACAAGGGCCTAGACGGGAAAAGTTTCAACGAT |
| DR (SEQ ID NO: 996) | GTTTCAACACCCCTCCCGGAGTGGGGCGGGTTGAAAG |
| sgRNA (SEQ ID NO: 997) | TTCACTAATCTGAACCTTGAAAATATAATATTTGTATAACAGCGCCGCAGTTCATGCTCTTTTGAGCCAATGTACTGT<br>GATAAATCTGGGTTAGTTTGGCAGTTGGAAGACTGTTATGCTTTCTGACCCTGGTAGCTGCCCGCTTCTGATGCTGCC<br>ATCTGTAGACTTCTATAGATGGGATAGGTGCGCTCCCAGCAATAAGGAGTAAAGCTTTTAGCTGTAACCGTTATTTA<br>TAACGGTGTGGATTACCACAGTGGTGGCTACTGAATCACCCCCTTCGTCGGGGGAACCCTCCCAAATATTTTTTGG<br>CGAATCGAAGCGGGGTCAAAATCCCTGGGGACTTGCCAAACTCTGAAAACCCTTGTCCTGTATTGAATCAAAGAAT<br>CATTTTGTAAATTGATTTACTATTTTGATTTTCAGCACAAGCAGCTTTTTCAGGGACGTGTCAATTAGACATCTGAAA<br>AGCTTGTATAACAAGGGCCTAGACGGGAAAAGTTTCAACGATGAAATCCCGGAGTGGGCGGGTTGAAAGNNNN<br>NNNNNNNNNNNNNNNNN |

TABLE 27-continued

| Name/<br>Organism/<br>System<br>ID (T) | | Sequences |
|---|---|---|
| | LE<br>(SEQ ID<br>NO: 998) | TTGATGGCTGAAAGCTAGGAAATACGTAAATTATGCGTTTAGCACTGTCAAATGGACAATAATTCTTTAAAACTGAC<br>AATAATTATTTAAAGTACATATTGTACATTCGCACATTATATGTCGCAATTTGCAAACAACGACATTAGACGACATT<br>AGCATCTTGAGCATCTAAAACGCTTATCGTATAAACGTTTCAGGAAATTGTTAATTAAAAACGTTAAATTCCTGACT<br>TCGCACATTGTATGTCGCTAACATTAAAGCTCGCAAATTAATGTCGTTAATCTAAATTTTGTCACATTGCAAATTCAA<br>TGTCGCATTTTCTTCAGTTAATGGTACATTAATACTACCAATAACTACATTCTCCTCGCTTAAATGCCAGACAAAGAA<br>TTTGGATTAACCGGAGAATTGACACAAATTACAGAAGCTATTTTCCTTAGTGAAAGTAATTTTGTGGTCGATCCATT<br>ACACATTATTCTGGAATCCTCAGATAGCCAGAAACT |
| | RE<br>(SEQ ID<br>NO: 999) | CATCCCGGCTAGGGGTGGGTTGAAAGAGTAAGAAGAATAGAAGTAATTTCCTGAAATCAACTATATTTGGACATAT<br>TTTAGGAATATAACTAAATTATGGGAGGGTTGAAAGGAGCGCTGCGATCAAACAAATGTTAAGGTAAAATAATTCG<br>TCTGTAGCAAATACCACAGTTAATGAGTAAGCCATACGACGTTAATTTGCGAAAAACTAATATGATTGAATTAACG<br>ACGCGAATTAGCGAAAGTAATGTTAATTACCTAAAAACGACATCAATTTGCGAAAAGCGACAAATAATGTGCGAAT<br>GTACACATATGGAGAATAGGGAACTCGAATCCCTGACCTCTGCGGTGCGATCGCAGCGCTCTACCAACTGAGCTAA<br>TTCCCCTGACTTTGTTGAGTGTTCAGTTAATCACACTCGTCCATCATAGAGTATTTTAACATTCAGTTAGGGATGGCT<br>GAGATTTGTTGCCAGAAAAAACTTCTTGTACTCGCTCTAGTT |
| AP018178/<br>Calothrix<br>sp.<br>NIES-2100/<br>T36 | TnsB<br>(SEQ ID<br>NO: 1000) | ATGTCTGCCCTGGACGTGGACGACGACTTCGAGCTGGAAGAGGACACATACCTGCTGGGCGACGAGGACGCCGACC<br>TGTTTGATGATAGCAGCGACGTGATCCTGGTCAACGAGGACTACGACACCGCCGAAGAGGATAAGAGCGTGGAATT<br>CCTGGACCAGCGGTTCCTGGAAGATAGCGAGCTGAGACTGAGCGGCGAGCAGAGGCTGAAGCTGGAAATCATCAG<br>AAGCCTGGGCGAGCCCTGCGACAGAAAGACATATGGCCAGAAGCTGAAAGAGGCCGCACAGAAGCTGGGCAAGAG<br>CGAGAGAACAGTGCGGAGACTGGTCAAGGCCTGGCAAGAGAATGGCCTGGCCACCTTTGCCGAAACCGCCAGAGC<br>TGATAAGGGCCAGACCAGAAAGAGCGAGTACTGGTACAACCTGACCGTCAAGACCTACAAGGCCCGGAACAAGGG<br>CAGCGACCGGATGACAAGAACACAGGTGGCCGAGAAGATCGCCATCAGAGCCTATGAGCTGGCCAAGAACGAGCT<br>GAAGCAAGAGATCAGCAAGCTCGAGACACAGGGCTTCAGAGGCGAGGAACTGGACTGGAAGGTGGACACCCTGAT<br>CAAGACCAAGGCCAAGACCGAGGGCTTCAACTACTGGCAGAAGTACGGCAAGGCCCCTTGCGCGCAGAACCGTGGA<br>AAGATGGCTGAAGCCCCTGGAAGAGAAGAAGCACAAGAGCCGGACCAGCAGATCTCCTGGCTGGCACGGATCTGA<br>GCACGTGATCAAAACCCGGGACGACCAAGAGATCTCCATCAAGTACAGCAATCAAGTGTGGCAGATCGACCACACC<br>AAGGCCGATCTGCTGCTGGTGGATGAGGACGGCGAGGAAATTGGCAGACCTCAGCTGACCACCGTGATCGACTGCT<br>ACAGCAGATGCATCGTGGGCTGAGACTGGGCTTGCCGCACCATCTTCTCAGGTGGTGGCTCTGGCCCTGAGAAAC<br>GCCATCATGCCCAAGAGATACGGCAGCGAGTACGAGCTGAGGTGCAAGTGGAGTGCCTACGGCGTGCCCAGATACG<br>TGTACACAGATGGCGGCAAGGACTTCCGGTCCAAGCACTGGTGGAATGGATCGCCAACGAGCTGGATTTCGAGCC<br>CATCCTGAGAAGCCAGCCTTCTGACGGCGGAATCGTGGAAAGGCCCTTCAGAACAATGAGCGGCCTGCTGTCTGAG<br>ATGCCTGGCTACACAGGCAGCAGCGTGAAGGATAGACCTGAGGGCGCCGAGAAAAAGGCCTGCATCTCTCTGCCTG<br>AGCTGGAAAAGCTGATCGTGGGCTACATCGTGGACAGCTACAACCAGAAGCCAGACGCCAGATCACAGGCCAATCC<br>TTTCACACACCAAGCAGAGCCGGATCGAGAGATGGGACGAAGGGCCTGCAGATGCCTCCTACACTGCTGAACGACAGA<br>GAGCTGGACATCGCCTGATGAAGGCCGCCGAGAGAGTGGTGTACGACAACGGCTACCTGAACTTCAGCGGCCTGA<br>GATACAGGGGCGAGAATCTGGGAGCCTACGCCGGCGAGAAAGTGATCCTGAGATTCGACCCCAGAGACATCACAA<br>TGGTGCTGGTGTACGGCCGGACCAACAACAAAGAGATCTTTCTGGCCAGGGCCTATGCCGTGGGACTCGAAGCAGA<br>GAGGCTGAGCATCGAGGAAGTGAAGTACGCCCGGAAGAAGGCCGAGAATAGCGGCAAGGGCATCAACAATATCGC<br>CATCCTCGAAGAGGCTATCCGGCGGAGAAACTTCCTGGACAAGAAGAAAAACAAGACCAAAGCCGAGCGGAGGCG<br>GAGCGAGGAAAAGAGAGTTGAGCAGATCCCTCAGGTGCTGAAGGACAAGAAACCCGAACAGGTGGAAAGCTTCAA<br>CAGCCAGCCGGACGAGTCCATCGCAAGGACTGGATCTGAAGTCCCTGCGGGAAGAACTGGGCCTGTAA |
| | TnsC<br>(SEQ ID<br>NO: 1001) | ATGACCAACGAGGAAATCCAGCAAGAGATCGAGCGGCTGAGACAGCCCGACATCCTGAACATCGAGCAAGTGAAG<br>AGATTCGGCGCCTGGCTGGACGAGCGGAGAAAGCTGAGAAAACCTGGCAGAGCCGTGGGCGATTCTGGCCTGGGA<br>AAAACAACCGCCAGCCTGTTCTACACCTACCAGAACCGGGCCGTGAAGATCCCCAATCAGAACCCTGTGGTGCCCG<br>TGCCTGTACGTGGAACTGACAGGCAGCAGCGCTGTAGCCCCAGCCTGCTGTTCAAGACCATCATCGAGACACTGAAGTT<br>CAAGGCCAAAGGCGGCAACGAGACACAGCTGAGAGAGAGCGAGGAGCCTGGTACTTCATCAAGCAGTGCAAGGTGGAAGT<br>GCTGATCATCGACGAGGCCCACCGGCTGCAGTTTAAGACACTGGCTGATGTGCGGGACCTGTTCGACAAAGTGAAG<br>ATCGTGCCTGTGCTCGTGGGCCACCAGCAGCAGACTGGATACCCTGATCAGCAAGGACGAACAGGTGGCCGGCAGAT<br>TCGCCAGCTACTTCAGCTTCGAGAAGCTGTCCGGCGCCAATTTCATCAAGATCCTGAAGATCTGGGAGCAGCAGATC<br>CTGAGGCTGCCCGAGCCTTCTAATCTGGCCGACAGCCAAGAGATCATCACCATCCTGCAAGAGAAACCAGCGACC<br>AGATCCGGCTGCTGGACCAGATTCTGAGAGATGCCGCCGTGAAGGCCCTGGAATCTGGCGTGAACAAGATCGACAA<br>GAGCCTGCTGGACAGCATCGAGGGCGATTATAGCCTCGTGGGCTCCTGA |
| | TniQ<br>(SEQ ID<br>NO: 1002) | ATGTGCAACGAGATCTACAACTTCGAGGCCTGGATCAACATCGTGGAACCCTTTCCAGGCGAGAGCATCAGCCACT<br>TTCTGGGCAGATTCGAGCGGGCCAATCTGCTGACAGGCTACCAGATCGGAAAAGAGGCCGGCGTTGGAGCCATCGT<br>GACCAGATGGAAGAAGCTGTACCTGAATCCGTTTCCGACACAGCAAGAGCTGGAAGCCCTGGCCAACTTCGTGGAA<br>GTGGCCACCGAGAAGCTGAAAGAAATGCTGCCCGTGAAGGGCATGACCATGAAGCCCAGACCTATCAAGCTGTGCG<br>CCGCCTGTTATGCCGAGCAGCCCTATCACAGAATCGAGTGGCAGTACAAGGACAAGCTGAAGTGCGACCGGCACAA<br>CCTGAGACTGCTGACCAAGTGCACCAACCTGTCAGACCCCTTTTCCTATTCCTGCCGACTGGGTGGAAGGCAAGTGCA<br>GCCACTGCAGCCTGAGATTTGCCACCATGGCCAAGCGGCCAGAAACCCAGTAA |
| | Cas12k<br>(SEQ ID<br>NO: 1003) | ATGAGCGTGATCACCATCCAGTGCAGACTGATCGCCCACGTGGCCACACTGAGATACCTGTGGAAGCTGATGGCCG<br>AGAAGAACACCCCTCTGATCAACGAGCTGCTGGAACAGGTGGCCGAGCATCCCAATTTTGAGGCCTGGCTGAAGAA<br>AGGCGAGGTGTCCAAGACCGCCATCAAGACCATCTGCAACGACTCTGAAAACCCAAGAGCCTGAGAGCTGACCAACACCAGCCT<br>GGCCGGTTCTACAAGCGCCGTGACACTGGTCACGAGGTGTACAAGTCTTGGTTTGCCCTGCAGCAGCGGCGGC<br>AGAGACAGATCAACGGCAAGAACGGTGGCTGAACATGCTGAAGTCCGACATCGAGCTGCAGCAAGAGTCCCAGT<br>GCGACCTGAACGTGATCAGAGCCAAGGCCACCGAGATCCTGAACAAGTTCAACGCCAAGTTCAGCCAGAAGAAGA<br>AGTACAAGCAAGAAGAAGGCCAACAACACCAAGAACAAGAACAAAGAGTTTCTGAACAACACCCTGTTCAGCG<br>CCCTGTTCGATATGTACGACAAGACCGAGGACTGCCTGAGCAAGTGTGCCCTGGCCTACCTGCTGAAGAACAACTG<br>CGAAGTGAACGAGCTGGACGAGGACCAAGAGAAGTACGCCAAAAACAAGCGGCAGAAAGAGATCGAGATCGAGC<br>GCCTGAAGAAGCAGATCATCAGCAGAAAGCCCAAAGGCCGGGACATCACCGCCGAGAAGTGGCTGTCTACACTGG<br>AAAAGCCACCAAGCAGGTGTCCCAGACGAGGATGAGGGCAGCTTGGCAGGCCAGCCTGCTGAGAAGAGACAA<br>GCTGCATGCCCTATCCTATCGACTACGACAGCGACGACCTGGAATGGCCGTGAACTCTCTGGCCGAAAAAAACAA<br>CATCCTCGAGCAGTCTAAGTACGACGTGGACAACGAGGCCTACAAGGATGTGAATTGGAGCGACATCAAAACAA<br>AGAGGGCTACATCCTGGTCAAGTTCAATGGCCTCAAAGAGATCATCAAGCACCCCGAGTTCTACGTGGGCTGCGAC<br>AGCAGACAGCTGGACTACTTCCAGCGGTTCTGCCAGGACTGGAAGATCTGGAACGAGAATCAAGACACATAGCT<br>CCGGCCTGTTCCTGCTGCGCTCTGCTAGACTGCTGTGTGGCAAGAGAGAAAAGGCAAGGGCGACCCTTGGACCGTGCA |

TABLE 27-continued

| Name/<br>Organism/<br>System<br>ID (T) | | Sequences |
|---|---|---|
| | | CAGACTGATTCTGCAGTGCAGCATCGAGACACGGCTGTGGACCCAAGAGGAAACCGAACTCGTCCGGCTGGAAAAG<br>ATCGACCAGGCCGATAAGACAATCAGCAACATGGAAAAGAAGGACAGCCTCAACAAGAACCAGGTCGCCTACCTG<br>AAGAAAACCCTGACCACCAGACGGAAGCTGAACAACCCATTTCCAGGCAGACCCTCTCAGGCCCTGTACCAGGGAA<br>AGTCCTCTATCCTCGTGGGCGTGTCCCTGGGCCTTGATAAGCCTGCTACAGTGGCCGTGGTGGATGCCGCCTCTAAG<br>AAGGTGCTGACCTACAGAAGCGTGAAACAGCTGCTGGGCCAGAAGTATAATCTGCTGAACCGGCAGCGCCAGCAGC<br>AGCAGAGACTGTCTCACGAGAGACACAAAGCCCAGAAGCAGAACGCCCCTAACAGCGCCTCTGAGTCTGAGCTGG<br>GACAGTACATCGACAGACTGCTGGCCGATGCCATCGTCGTGGCCATTGCCAAGACATACTCCGCCAGCTCCATCGTGCTG<br>CCCAAGCTGCAAGATCTGCACGAGATCATCGAGAGCGAGATCCAAGTGAAGGCCGAGAAAAAGGTGCCCGGCTAC<br>AAAGAAGGGCAGAAGAACTACGCCAAGCAGTACAGAGTGAACATCCACAGATGGTCCTACGGCCGGCTGTTCAAG<br>ATCATTCAGTCTCAGGCCGCCAAGGCCTCCATCCTCATCGAGATCACCAGCAGCGTCATCGAAGCAGCCCTCAAG<br>AGAAAGCCAGAGATCTGGCCCTGCTGGCCTATCAAGAGAGACAGGCCAAGCTGACCTGA |
| | TracrRNA<br>(SEQ ID<br>NO: 1004) | TTGATGCAAAAATTCTGAACCTTGACAATATAATAAGAAAATAATAGCGCCGCAGTTCATGCTCTTTAGAACGGCTC<br>TAAAGAGCCGCTGTACTGTGAAAAATCTGGGTTAGGTTGACCATAGCGAAGATTGGTCGATGCTTTCTGACCCTGGT<br>AGCTGCCCGCTTCTGATGCTGCCATCTGTAGAATTCTATAGATGGGATAGGTGCGCTCCCAGCAATAAGAAGTAAGG<br>CTTTTTAGCAATAGCCGTTGTTCGCAACGGTGCGGGTTACCGCAGTGGTGGCTACTGAATCACCCCCTTCGTCGGGGG<br>AACCCTCCAAAATATTTTTTGGCATGTCAAAGCGGGGGCAAAATCCCTGGAGTCCTGCCAGAATATTAAAACCCTT<br>ATCCAGTCTTAGCTAGCAAAACTAGTGTGTCAATGCATTTAGTTTTTTGATTTTTGGTTTGAGACTCTATTAAGCAGA<br>CCTGCCAAATTATGTGTATGGAAAGCTTTTATAGGAAGGGTTCTAGACGGGTCG |
| | DR<br>(SEQ ID<br>NO: 1005) | GTTTCAACAACCATCCCGGCTAGGGGTGGGTTGAAAG |
| | sgRNA<br>(SEQ ID<br>NO: 1006) | TTGATGCAAAAATTCTGAACCTTGACAATATAATAAGAAAATAATAGCGCCGCAGTTCATGCTCTTTAGAACGGCTC<br>TAAAGAGCCGCTGTACTGTGAAAAATCTGGGTTAGGTTGACCATAGCGAAGATTGGTCGATGCTTTCTGACCCTGGT<br>AGCTGCCCGCTTCTGATGCTGCCATCTGTAGAATTCTATAGATGGGATAGGTGCGCTCCCAGCAATAAGAAGTAAGG<br>CTTTTTAGCAATAGCCGTTGTTCGCAACGGTGCGGGTTACCGCAGTGGTGGCTACTGAATCACCCCCTTCGTCGGGGG<br>AACCCTCCAAAATATTTTTTGGCATGTCAAAGCGGGGGCAAAATCCCTGGAGTCCTGCCAGAATATTAAAACCCTT<br>ATCCAGTCTTAGCTAGCAAAACTAGTGTGTCAATGCATTTAGTTTTTTGATTTTTGGTTTGAGACTCTATTAAGCAGA<br>CCTGCCAAATTATGTGTATGGAAAGCTTTTATAGGAAGGGTTCTAGACGGGTCGGAAATCCCGGCTAGGGGTGGGT<br>TGAAAGNNNNNNNNNNNNNNNNNNNNNNN |
| | LE<br>(SEQ ID<br>NO: 1007) | AAAAAGCATTGAGAGACCCTTTCACAAAGGCAATCATCCTCGCTCAATAATTACAATTCTCAACACTTAAGTCCAAC<br>TTGCCTGGAGTAAAGCCATCAATCTGTCAACGCGGACAAATAATTTGGCAATCGACACTGTAGAGCGACAAATTAT<br>TTGACCACATCGACAAATTATTTGTCACATTAATACATTAGTGAACAATCCTTATATACCAATACTTTTCACCATTTG<br>ATAGCTAAGAAAGCTGTTTAGGTTGTCTGCCACAAATTATGTGTCATTTTTTTAGTAATCCGACACATTAAGCGTCAT<br>TTGTTAATTTGGCGAAAAATTAGCTGTCAATTCTTCACAGCTTTATAGTAGTATAAATGTACGTTAGTTTTTCACAAA<br>AAAATTACATCTATGAGCGCTTTAGATGTAGATGACGATTTTGAACTGGAAGAAGATACCTACCTATTAGGTGATGA<br>AGATGCAGACCTGTTCGATGACTCATCGGATGTAAT |
| | RE<br>(SEQ ID<br>NO: 1008) | AGTTTTTAACAACCATCCAATTAGGGCTGGGTTGAAAGCAAATTTTTGTCGTTACTATGTGAAATATTTGTTTGAATT<br>AGGAGGGTTGAAAGGCGCACTTCGTTCGGGATAATTCCGACACTGTGTATAGTAAAATCTATGCGACTTCAATTAGG<br>AAAATCATCTCTGGAAAGAGATTGACAAATAATTTGTCGTTTTGGTTTTTTGACAAATAATATGTCGCCACGGACAG<br>ATAATTTGTCGCTTTACAACAATAATCGGGATGACTGGATTCGAACCAGCGGCCCCTTCGTCCCGAACGAAGTGCGC<br>TACCAAGCTGCGCTACATCCCGGCATAATAAGCCATCGTTGTTTAAATATGATATCATTAATAATGGTAAATGTACACC<br>CATGCTGATTTTTATTTGGGAAATTGCGATCGCTCGGGTAGAATAGTCGAATCACCTGAAAGTTCTGATTTTCAAAA<br>CATGGTGACTAACAGTAATCATCAGTGAGATAATTTT |
| AP018178/<br>Calothrix<br>sp.<br>NIES-2100/<br>T37 | TnsB<br>(SEQ ID<br>NO: 1009) | ATGCTGGACGAGCACAGCAACGGCGATCAAGAGCCCGAGAACGACGAGATCGTGACAGAGCTGAGCGCCGACAAC<br>CGGCATCTGCTGGAAATGATCCAGCAGCTCCTGGAACCTTGCGACCGGATCACATACGGCGAGAGACAGAGAGAGG<br>TGGCCGCCAAGCTGGGAAAGTCTGTGCGGACAGTTCGGCGGCTGGTCAAGAAGTGGGAAGAAGAAGGACTGGCCG<br>CTCTGCAGACAACCGCCAGAGCCGATAAGGGCAAGCACAGAATCGACACCGACTGGCAGCAGTTCATCATCAAGAC<br>CTACAAAGAGGGCAACAAGGGCAGCAAGCGGATCACCCCTCAGCAGGTTGCCATTAGAGTGCAGGCCAGAGCTGC<br>CGAGCTGGGCCAGAAGAAGTACCCCAGCTACCGACCCGTGTACAGAGTGCTGCAGCCCATCATCGAGCAGCAAGA<br>GCAGAAGGCCGGCGTCAGATCTAGAGGCTGGCACGGCTCTAGACTGAGCGTGAAAACCAGAGATGGCAAGGACCT<br>GAGCGTGGAATACTCCAACCACGTGTGGCAGTGCGACCACACCAGAGTGGATCTGCTGCTGGTGGATCAGCACGGC<br>GAACTGCTTGGTAGACCTTGGCTGACCACCGTGGTGGACACCTACTCCAGATGCATCATGGGCATCAACCTGGGCTT<br>CGACGCCCCTAGTTCTCAGGTTGTGGCCCTGGCCGTTAGACACGCCATTCTGCCTAAGCAGTACGGCAGCGAGTACG<br>GCCTGCACGAGGAATGGGGCACATATGGCAAGCCCGAGCACTTCTACACCGACGGCGGCAAGGACTTCAGAAGCA<br>ACCATCTGCAGCAGATTGGCGTGCAGCTGGCTTTGTGTGCCACCTGAGAGACAGGCCATCTGAAGGCGGCATCGT<br>GGAAAGACCCTTCGGAACCTTCAACACCGATTTCTTCAGCACCCTGCCTGGCTACACCGGCAGCAATGTGCAAGAA<br>AGACCTGACCAGGCCGAGAAAGAGGCCTGTCTGACCCTGAGAGACTGGAACACAGATTCGTGCGGTACATCGTGG<br>ACAAGTACAACCAGCGGCCTGACGCCAGACTGGGCGATCAGACAAGATATCAGAGATGGGAGGCCGGACTGATCG<br>CTAGCCCCAACGTGATCAGCGAGGAAGAACTGCGGATCTGCCTGATGAAGCAGACCCGGCGGAGCATCTACAGAG<br>GCGGCTATCTGCAGTTCGAGAACCTGACCTACCGGGGCGAAAATCTGGCCGGATATGCTGGCGAGAGCGTGGTGCT<br>GAGATACGACCCCAAGGACATCACCACACTGGTGTACAGACGCGGCAACAAGGAAGAGTTCCTGGCCAG<br>AGCCTTCGCTCAGGACCTGGAAACAGAACAGCTGAGCCTGGATGAGGCCAAGGCCAGCTCCAGAAAGATTAGACA<br>GGCCGGCAAGATGATCAGCAACCGGTCCATGCTGGCCGAAGTGCGGGACAGAGAAACCTTCGTGACCCAGAAAAA<br>GACCAAGAAAGAGCGGCAGAAAGCCGAACAGGCCGTGGTCGAGAAGGCCAAGAAACCCGTTCCTCTGGAACCAGA<br>GAAAGAAATGAGGTGGCCAGCGTGGACAGCGAGAGCAAGTATCAGATGCCCGAGGTGTTCGACTACGAGGAAAT<br>GCGGGAAGAGTACGGCTGGTGA |
| | TnsC<br>(SEQ ID<br>NO: 1010) | ATGACAAGCAAGCAGGCCCAGGCCATTGCTCAGCAGCTGGGAGACATCCCCGTGAACGATGAGAAGCTGCAGGCC<br>GAGATCCAGCGGCTGAACAGAAAGAGCTTCATCCCTCTGGAACAAGTGAAGATGCTGCACGACTGGCTGGACGGCA<br>AGAGACAGAGACACGTCTGGCAGAGCTGTGGGCGAGAGCAAGCCAAGACCATGGCGTGATGCTGGTGACGCTACA<br>GACTGCGGCACAAGCCTAAGCAAGAGCCCGCAAACCTCCTACAGTGCCCGTGGCCTACATCCAGATTCCTCAAGA<br>GTGCAGCGCCAAAGAGCTGTTCGCCGCCATCATCGAGCACCTGAAGTACCAGATGACCAAGGGCACCGTGGCCGAG<br>ATTCGGGAAAGAACCCTGAGAGTGCTGAAAGGCTGCGGCGTGAAATGCTGATCATCGACGAGGCCGACCGGTTCA<br>AGCCCAAGACCTTTGCTGAAGTGCGGGACATCTTCGACAAGCTGGAAATCGCCGTGATCCTCGTGGGCACCGATAG<br>ACTGGATGCCGTGATCAAGCGGGACGAACAGGTGTACAACCGGTTCAGAAGCTGCCACAGATTCGGCAAGTTCAGC TABLE 27-continued

| Name/<br>Organism/<br>System<br>ID (T) | | Sequences |
|---|---|---|
| | | GGCGAGGACTTCCAGCGGACAGTGGAAATCTGGGAGAAACAGGTGCTGAAGCTGCCTGTGGCCAGCAACCTGAGC<br>AGCAAGACAATGCTGAAAACCCTGGGCGAAACCACCGGCGGCTATATCGGACTGCTGGACATGATCCTGAGAGAG<br>AGCGCCATTCGGGCCCTGAAGAAAGCCTGGCCAAGATCGACCTGGAAACCCTGAAAGAAGTGGCCGCCGAGTAC<br>AAGTGA |
| | TniQ<br>(SEQ ID<br>NO: 1011) | ATGGAAGTGCCCGAGATCCAGAGCTGGCTGTTCCAGGTGGAACCTCTGGAAGGCGAGAGCCTGTCTCACTTCCTGG<br>GCAGATTCAGACGGACCAACGATCTGACAGCCACCGGCCTGGGAAAAGCCGCTGGACTTGGCGGAGTGATTGCCAG |
| | Cas12k<br>(SEQ ID<br>NO: 1012) | ATGAGCCAGATCACCATCCAGTGCAGACTGGTGGCCAGCGAGGACACAAGACAGCAGCTGTGGAAGCTGATGGCC<br>GAGCTGAACACCCCTCTGATCAACGAGCTGCTGCGGCAAGTGCACCAGCATCCTGAGTTTGAGACATGGCGGCAGA<br>AGGGCAAGCACCCCACCTCCATTGTGAAAGAGCTGTGCCAGCCTCTGAAAACAGACCCCAGCTTCATCGGCCAGCC<br>AGGCAGATTCTACACCAGCGCCATTGCCACCGTGAACTACATCTACAAGAGCTGGTTCAAGCTGATGAAGCGGAGC<br>CAGAGCCAGCTGGAAGGCAAGATTCGTTGGTGGGAGATGCTGAAGTCCGACGCCGAGCTGGTGGAAGTGTCTGGCG<br>TGACACTGGAAAGCCTGAGAAGCAAGGCCGACGAGATTCTGGCCCACTTCACCCCTCAGAGCGACACCGTTGAAGC<br>CCAGCCTGGAAAGGGCAACAAGCGGAAAAAGACCAAGAAAAGCAAGGTGGCCGAGGGCGACTGTGCCGAGAGAA<br>CACTGAGAGAGCGGAGCATCAGCAAGACCCTGTTCGAGGCCTACAGAGACACCGAGGACATCCTGACACACTGCGC<br>CATCTCTTACCTGCTGAAGAACGGCTGCAAGATCAACGACAAGAGAGGACACCCAGAAGTTCGCCAAGCGGCG<br>GAGAAAGCTGGAAATCCAGATCGAGCGGCTGCGCGAACAGCTCGAGGCCAGAATTCCTAAGGGCCGCGATCGAC<br>CAACGGCAAGTGGCTGGAAACACTGCTGCTGGCCACACACAATGTGCCCGAGTCTGAGACAGAGGCCAAGTCCTGG<br>CAGGACAGCCTCCTGAAGAAAAGCTCCAAGGTGCCATTTCCTATCGCCTACGAGACAAACGAGGATATGACCTGGT<br>TTAAGAACGAGCGGGGCAGAATCTGCGTGAAGTTCAACGGCCTGAGCGAGCACAGCTTCCAGTGTACTGCGACAG<br>CAGACAGCTGCACTGGTTCCAGCGGTTTTCTGGAAGATCAGCAGATCAAGCAGAACAGCAAGAACCAGCACAGCAG<br>CAGCCTGTTCACCCTGAGATCTGGCAGGATCGCCTGGCAAGAAGGCGAAGGCAAAGGCGAGGAATGGAAAGTGAA<br>CCACCTGATCTTCTACTGCAGCGTGGACACCAGACTGTGGACCGCCGAGGGAACAAATCTCGTGCGCGTGGAAAAG<br>GCCGAGGAAATCCAAGACCATCACACAGACCAAGGCCAAGGGCGAGTCTGAATGATCAGCAGCTGGCCCACATC<br>AAGCGGAAGAACTCTTCTCTGGCCCGGATCAACAACAGCTTCCCCAGACCTAGCAAGCCCCTGTACCAGGGCCAGT<br>CTCATATCCTGGTGGCCGTGTCTCTGGGACTCGAGAAACCTGCTACAGTGGCCGTGGTGGATGGCACCATCGGAAA<br>GGTGCTGACCTACCGGTCTATCAGGCAGCTGCTGGGCGACAACTACAAGCTGCTGAACCGGCAGAGACAGCAGAAG<br>CACACACTGAGCCACCAGAGACAGATCGCCCAGATGCTGGCCGCTCCTAATGAGCTGGGAGAGTCTGAACTGGGCG<br>AGTACATCGAGAGACTGCTCGCCAAAGAGATCATTGCCATTGCTCAGACCTACAAGGCCGGCTCCATCGTGCTGCCC<br>AAACTGGGAGACATGAGAGAACAGGTGCAGAGCGAGATCCAGGCCAAGGCCGAACAGAAGTCCGATCTGATCGAG<br>GTGCAGCAGAAGTATGCCAAGCAGTACCGGGTGTCCACACACCAGTGGTCCTACGGCAGACTGATCGAGAACATCA<br>GAAGCAGCGCCGCCAAGACAGGCATCGTGATCGAGGAAAAGCAAGCAGCCCATCCGGGGAAGCCCTCAAGAGAAGG<br>CCAAGAGCTGGCTATCGCCGCCTACCACAGCCAGCAGAAAACATGA |
| | TracrRNA<br>(SEQ ID<br>NO: 1013) | TTGACAAAACACCGAACCTTGAAAATAGAATAAGTATCATTAATAGCGTCGCAGTTCATGCTTGTATAAAGCCGCTG<br>TGCTGTGTAAATGTGGGTTAGTTTGACTGCTGTTAAACAGTCTTGCTTTCTGACCCTGGTAGCTGCCCACCTTGATGC<br>TGCTATCCCTTGTGGATAGGAATAAGGTGCGCCCCAGTAATAGAGGTGCGGGTTTACCGCAGTGGTGGCTACTGA<br>ATCACCTCCGACCAAGGAGGAACCCACCTTAATTATTTTTTGGCGAATCGAAGCGGGTCAATTTCCTGGGGATCTG<br>CCAAAACTTCAAATCGCTTATTGATTAAGGCTTGTAGCTTTTATGGTGTCAGTTAATTTACTTTTTTAAGTGTTAAGT<br>GACAGGCGATTTTGGCAGATCTGACAAAAATGCTTCTAGAAGTCTTTATTGGTGAAGGATTTGAGGCGCTGGG |
| | DR<br>(SEQ ID<br>NO: 1014) | GTTTCAATACCCCTCACAGCTTGAGGCGGGTTGAAAG |
| | sgRNA<br>(SEQ ID<br>NO: 1015) | TTGACAAAACACCGAACCTTGAAAATAGAATAAGTATCATTAATAGCGTCGCAGTTCATGCTTGTATAAAGCCGCTG<br>TGCTGTGTAAATGTGGGTTAGTTTGACTGCTGTTAAACAGTCTTGCTTTCTGACCCTGGTAGCTGCCCACCTTGATGC<br>TGCTATCCCTTGTGGATAGGAATAAGGTGCGCCCCAGTAATAGAGGTGCGGGTTTACCGCAGTGGTGGCTACTGA<br>ATCACCTCCGACCAAGGAGGAACCCACCTTAATTATTTTTTGGCGAATCGAAGCGGGTCAATTTCCTGGGGATCTG<br>CCAAAACTTCAAATCGCTTATTGATTAAGGCTTGTAGCTTTTATGGTGTCAGTTAATTTACTTTTTTAAGTGTTAAGT<br>GACAGGCGATTTTGGCAGATCTGACAAAAATGCTTCTAGAAGTCTTTATTGGTGAAGGATTTGAGGCGCTGGGAAA<br>TCACAGCTTGAGGCGGGTTGAAAGNNNNNNNNNNNNNNNNNNNNNNNN |
| | LE<br>(SEQ ID<br>NO: 1016) | CATTGAGAGACCCTTTCACAAAGGCAATCATCCTCGCTCAATAATTACAATTCTCAACACTTAAGTCCAACTTGCCT<br>GGAGTAAAGCCATCAATCTGTCAACGCGGACAAATAATTTGGCAATCGACACTGTAGAGCGACAAATTATTTGACC<br>ACATCGACAAATTATTTGTCACATTAATACATTAGTGAACAATCCTTATATACCAATACTTTTCACCATTTGATAGCT<br>AAGAAAGCTGTTTAGGTTGTCTGCCACAAATTATGTGTCATTTTTTTAGTAATCCGACACATTAAGCGTCATTTGTTA<br>ATTTGGCGAAAATTAGCTGTCAATTCTTCACAGCTTTATAGTAGTATAAATGTACGTTAGTTTTTCACAAAAAAATT<br>ACATCTATGAGCGCTTTAGATGTAGATGACGATTTTGAACTGGAAGAAGATACCTACCTATTAGGTGATGAAGATGC<br>AGACCTGTTCGATGACTCATCGGATGTAATACTTGT |
| | RE<br>(SEQ ID<br>NO: 1017) | AGTTTTAACAACCATCCCAATTAGGGCTGGGTTGAAAGCAAATTTTTGTCGTTACTATGTGAAATATTTGTTTGAATT<br>AGGAGGGTTGAAAGCGCACTTCGTTCGGGATAATTCCGACACTGTGTATAGTAAAATCTATGCGACTTCAATTAGG<br>AAAATCATCTCTGGAAAGAGATTGACAAATAATTTGTCGTTTTGGTTTTTTGACAAATAATATGTCGCCACGGACAG<br>ATAATTTGTCGCTTTACAACAATAATCGGGATGACTGGATTGAACCAGCGGCCCCTTCGTCCCGAACGAAGTGCGC<br>TACCAAGCTGCGCTACATCCCGGCATAATAAGCCCATTGTTTAAATATGATATCATTAATAATGGTAAATGTACACC<br>CATGCTGATTTTTATTTGGGAATTGCGATCGCTCGGGTAGAAATAGTCGAATCACCTGAAAGTTCTGATTTTCAAAA<br>CATGGTGACTAACAGTAATCATCAGTGAGATAATTTT |
| AP018194/<br>Scytonema<br>sp. HK-05/<br>T38 | TnsB<br>(SEQ ID<br>NO: 1018) | ATGGGCGAGACACTGAACAGCAACGAGGTGGACGAGAGCCTGGTGCTGTACGATGGCTCTGACGAAGTGGATGAG<br>ATCAGCGAGGAGGACATCCAAGCAGCAACGTGATCGTGACCGAGCTGAGCGAAGAGGCCAGCTGAGAATG<br>CAGGTCCTGCAGAGCCTGATCGAGCCCTGCGACAGAAAGACCTACCGGCATCAAGCTGAAGCAGGCCGCCGAGAG<br>CTGGAAAGACCGTCAGAACAGTGCAGCGGCTGGTCAAGAAGTACAAGAGCAGGGACTGAGCGGTGACAGAG<br>GTGGAAAGATCTGACAAAGGCGGCTACCGGATCGACGACGACTGGCAGGACTTCATCGTGAAAACCTACAAAGAG<br>GGCAACAAAGGCGACGGAAGATGACCCCTGCTCAGGTGGCCATCAGAGTGCAAGTTCGCGCTGGACAGCTGGGC<br>CTCGAGAAGTACCCTTGTCACATGACCGTGTACCGGGTGCTGAACCCCATCATCGAGCGGAAAGAACAGAAACAGA |

TABLE 27-continued

| Name/<br>Organism/<br>System<br>ID (T) | Sequences |
|---|---|
| | AAGTGCGGAACATCGGCTGGCGGGGCAGCAGAGTTTCTCACCAGACAAGAGATGGCCAGACACTGGACGTGCACC<br>ACAGCAATCACGTGTGGCAGTGCGACCACACCAAGCTGGATGTGATGCTGGTGGACCAGTACGGCGAAACCCTGGC<br>TAGACCTTGGCTGACCAAGATCACCGACAGCTACAGCCGGTGCATCATGGGCATCCACCTGGGCTTTGATGCCCCTA<br>GCTCTCTGGTGGTGGCCCTGGCTATGAGACACGCCATGCTGAGGAAGCAGTACAGCAGCGAGTACAAGCTGCACTG<br>CGAGTGGGGCACATATGGCGTGCCCGAGAACCTGTTTACCGACGGCGGCAAGGACTTCAGAAGCGAGCACCTGAAG<br>CAGATCGGCTTCCAGCTGGGATTCGAGTGTCACCTGAGAGACAGACCTCCAGAAGGCGGCATCGAGGAAGAGGCT<br>TCGGAACAATCAATACCAGCTTCCTGAGCGGCTTCTACGGCTACCTGGACAGCAACGTGCAGAAGAGGCCTGAGGG<br>CGCCGAAGAGGAAGCCTGTATCACACTGAGAGAGCTGCATCTGCTGATCGTGCGGTACATCGTGGACAACTACAAC<br>CAGAGAATCGACGCCAGAAGCGGCAACCAGACCAGATTCCAGAGATGGGAAGCCGGCCTTCCTGCTCTGCCCAACC<br>TGGTCAATGAGCGCGAGCTGGACATCTGCCTGATGAAGAAAACCCGGCGGAGCATCTACAAAGGCGGATACGTGTC<br>CTTCGAGAACATCATGTACCGGGGCGACTACCTGTCTGCCTATGCCGGCAATCTGTGCTGCTGAGATACGACCCCA<br>GAGACATCAGCACCGTGTTCGTGTACAGACAGGACAGCGGCAAAGAGGTCCTGCTGTCTCAGGCCCACGCCATCGA<br>TCTGGAAACCGAGCAGATCAGCCTGGAAGAGACAAAGGCCGCCAGCAGAAGATCCGGAATGCCGGCAAGCAGCT<br>GAGCAACAAGTCTATCCTGGCCGAGGTGCAGGACCGGGACACCTTTATCAAGCAGAAGAAGAAGTCCCACAAGCA<br>GCGGAAGAAAGAGGAACAGGCCCAGGTCCACAGCGTGAAGTCTTTCCAGACCAAAGAACCCGTGGAAACCGTGGA<br>AGAGATCCCTCAGCCTCAGAAAAGACGGCCCAGAGTGTTCGACTACGAGCAGCTGCGGAAGGACTACGACGATTGA |
| TnsC<br>(SEQ ID<br>NO: 1019) | ATGGCCGAGGACTACCTGAGAAAATGGGTGCAGAACCTGTGGGCGACGACCCCATTCCTGAAGAACTGCTGCCCA<br>TCATCGAGCGGCTGATCACACCTAGCGTGGTGGAACTGGAACACATCCAGAAGATCCACGACTGGCTGGACAGCCT<br>GGAGACTGAGCAAGCAGTGCGGCAGAATTGTGGCCCCTCCTAGAGCCGGCAAGAGCGTGACATGTGACGTGTACAAG<br>CTGCTGAACAAGCCCCAGAAGAGAACCGGCAAGCGGGACATTGTGCCCGTGCTGTATATGCAGGCTCCCGGCGATT<br>GCTCTGCTGGCGAACTGCTGACACTGATCCTGGAAAGCCTGAAGTACGACGCCACCAGCGGCAAGCTGACCGACCT<br>GAGAAGAAGAGTGCTGCGGCTGCTGAAAGAAAGCAGAGTGGAAATGCTCGTGATCGACGAGGCCAACTTCCTGAA<br>GCTGAACACCTTCAGCGAGATCGCCCGGATCTACGACCTGCTGAAGATCAGCATCGTGCTCGTGGGCACCGACGGC<br>CTGGACAACCTGATTAAGAAGAGCGGTACATCCACGACCGGTTCATCGAGTGCTATAAGCTGCCCCTGGTGTCCG<br>AGAACAAGTTCCCCGAGTTCGTGCAGATCTGGGAAGATGAGGTGCTGTGCCTGCCTGTGCCTAGCAATCTGATCAA<br>GAGCGAGACACTGAAGCCCCTGTACCAGAAAACCTCCGGCAAGATCGGCCTGGTGGACAGAGTTCTGAGAAGGGC<br>CGCCATCCTGAGCCTGAGAAAGGGCCTGAAGAATATCGACAAGGCCACACTGGACGAGGTGCTCGAGTGGTTCGAA<br>TGA |
| TniQ<br>(SEQ ID<br>NO: 1020) | ATGGAAATCCCTGCCGAGCAGCCCAGATTCTTCCAGGTGGAACCTCTGGAAGGCGAGAGCCTGTCTCACTTCCTGGG<br>CAGATTCAGAAGAGAGAACTACCTGACCGCCACACAGCTGGGCAAGCTGACAGGCATTGGAGCCGTGATCAGCAG<br>ATGGGAGAAGTTCTACCTGAATCGTTTCCGACACCTCAAGAGCTGGAAGCCCTGGCCGCTGCTGTGGGAAGTGAAA<br>GTGGACCGGCTGATCGAGATGCTGCCTCCTAAGGGCGTGACCATGAAGCCCAGACCTATCAGACTGTGCGGCGCCT<br>GCTACCAAGAGTCCCCTTGTCACAGAGTGGAATGGCAGTTCAAGGACAAGCTGAAGTGCGTGTCCGAGGCTCACCC<br>CAAGGATGCCAGACATCAACTGGGCCTGCTGACAAAGTGCACCAACTGCGAGACACCCTTTCCTATACCTGCCGAC<br>TGGGTGCAGGGCGAGTGCCCTCACTGTTTTCTGCCCTTCGCCAAGATGGCCAGACGGCAGAAGAGATACTGA |
| Cas12k<br>(SEQ ID<br>NO: 1021) | ATGAGCGTGATCACCATCCAGTGCAGACTGGTGGCCGAGGAAAACACCCTGAGACAGCTGTGGGAGCTGATGGCCG<br>AGAAGAACACACCCCTGATCAACGAGCTGCTGGAACAAGTGGGACAGCACCCCAACTTCGAGAAGTGGCTGAAGA<br>AAGGCGAGGTGCCCGAGGAAGCCATCGACACCATCAAGAAGTCCCTGATCACCCAAGAGCCTTTCGCCGGCCAGCC<br>TGGCAGATTCTACACATCTGCCGTGACACTGGTCAAAGAGATCTACAAGAGTTGGTTCGCCCTGCAGCAAGAGCGG<br>CAGAGAAAGATCGAGGGCAAAGAACGGTGGCTGAAAATGCTGAAGTCCGACATCGAACTCCAGCAAGAGTCCCAG<br>TGCAACCTGGACATCATCCGGAACAAGGCCAACAAGATCCTGACCAGCTTCGTGGCCAACTTCACCGAGAACCGGA<br>ACCAGCAGTTCAAGAAGAAGGGCAACAAGACCAAGAACAAGAAAGAGGAAGAAGAGCACCCTGTTCAAC<br>GCCCTGTTTAAGATCTACGATAAGACCAAGGACTGCCTGAGCCAGTGCGCCCTGGCCTATCTGCTGAAGAACAACT<br>GCCAGGTGTCCGAGATCGACGAGGACCCCGAGGAATACGTGAAGCGCAGACGGCGGAAAGAGATCGAGATCGAGC<br>GCCTGCGGAAGCAGCTGAAGTCTAGAAAGCCCAAGGGCAGAGATCTGACCGGCGAAAATGGCTGACAGCCCTGA<br>AAGAGGCCACCAATCAGGTCCCCGTGGATCAGCTGGAAGCCAAGTCTTGGCAGGCTTCCCTGCTGAAAGTGACCAG<br>CGACATCCCCTATCCTGTGGACTACGAGAGCAACACCGACCTGGACTGGCTGATTCACAGCAACGACGACGACATC<br>AAGAAAAAGTGATCCTCGTGTGGCAGATCTACTTCCTGAAACAGCTGATCAAGTCCGGCAGCTACAGCTTCATCA<br>GTACCTGTACTTCCAGCGGGGCTGCCTGCCTAAGAGAGATGTGAACTGGCTGAACCTCAAGAACAAAGCCGGCAG<br>GATCTTCGTGAAGTTCAACGGCCTGAGGAAGAACATCATCAACCCCGAGTTCTACATCTGCTGCGACAGCCGGCAG<br>CGGCACTACTTCCAGAGACTGTGCCAGGACTGGCAAGTGTGGCACGACAACGAGGAAACCTACAGCAGCAGCCTGT<br>TCTTTCTGCGGAGCGCCAGACTGCTGTGGCAGAAGAGAAAAGGCACAGGCGCCCCTTGGAAAGTGAACCGGCTGAT<br>CCTGCAGTGCAGCATCGAGACAAGACTGTGGACCGAAGAGGAAACCGAACTCGTCCGGATCGAGAAGATCAACCA<br>GGCCGAGACAGAGATCAGAGAGAGCGAGCAGAAAGGCAAGCCCAAGCAGAAGGTGCTGAGCCACAGACAGAAGC<br>TGAACAATCTGTTCCCCAACAGACCCAGCAAGCCCATCTACAAGGGCAAGCCTAACATCATCGTGGGCGTGTCCTTC<br>GGCCTGGATAAGCCTGCTACAGTGGCCGTGGTGGATGTGGCCAACAAAAGGGTGCTGGCCTACCGGTCCACCAAAC<br>AGCTGCTGGGCAAGAACTACAACCTGCTGAACCGGCAGAGACAGCAACAGCAGAGGCTGTCTCACGAGAGACACA<br>AGGCCCAGAAGCGGAACGCCCCTAATAGCTTTGGCGAGTCTGAGCTGGGCCAGTACGTGGACAGACTGCTCGCCGA<br>TGCCATCATTGCCATTGCCAAGACATACCAGGCCGGCAGCATCGTGATCCCCAAGCTGAGAGACATGAGAGAGCAG<br>ATCACCAGCGAGATCCAGAGCAGAGCCGAGAAAAGTGCCCCGGCTACAAAGAGGCCCAGCAGAAGTACGCCAAA<br>GAATACCGGCTGAGCGTGCACAGATGGTCCTACGGCAGACTGATCGAGAGCATCAAGAGCCAGGCCGCAAAGTG<br>GGCATCAGCACAGATCGGCACCCAGCCTATCAGAGGCAGCCCTGAGGAAAAGGCTAGAGATCTGGCCGTGTTCG<br>CCTACCAAGAAAGACAGGCCGCTCTGGTGTAA |

TABLE 27-continued

| Name/<br>Organism/<br>System<br>ID (T) | | Sequences |
|---|---|---|
| | TracrRNA<br>(SEQ ID<br>NO: 1022) | TTCACTAATCTGAACCTTGAAAATATAATATTGTTATAACAGCGCCGCAGTTCATGCTCTTTCGAGCCTCTGTACTGT<br>GAAAAATCTGGGTTAGTTTGGCAGTTGTCAGACTGTCATGCTTTCTGACCCTGGTAGCTGCCCGCTTCTGATGCTGCC<br>ATCTGTAGAATTCTATAGATGGGATAGGTGCGCTCCCAGCAATAAGGAGTAAGGCTTTTAGCCATAGTCGTTATTCA<br>TAACGGTGTGGATTACCACAGTGGTGGCTACTGAATCACCCCCTTCGTCGGGGGAACCCTCCCAAATATTTTTTTG<br>GCAAAGCGAAGCGGGGCGAAATCCCTGGAGTCCTTGCCAAAATCTTAAAACCCTTGTTCTATATTAGTTTCATAAA<br>CTAAGGTGTCAATTGATTTAGTTTTTTCAAATTAGATTGAAGAAGCTTTTTAGCAGCATTGTCAAATTTGTATGCGAA<br>AAGCTTCAGTAACAAGGGTCTAGACGGGCAGA |
| | DR<br>(SEQ ID<br>NO: 1023) | GTTTCAACAACCATCCCGGCTAGGGGTGGGTTGAAAG |
| | sgRNA<br>(SEQ ID<br>NO: 1024) | TTCACTAATCTGAACCTTGAAAATATAATATTGTTATAACAGCGCCGCAGTTCATGCTCTTTCGAGCCTCTGTACTGT<br>GAAAAATCTGGGTTAGTTTGGCAGTTGTCAGACTGTCATGCTTTCTGACCCTGGTAGCTGCCCGCTTCTGATGCTGCC<br>ATCTGTAGAATTCTATAGATGGGATAGGTGCGCTCCCAGCAATAAGGAGTAAGGCTTTTAGCCATAGTCGTTATTCA<br>TAACGGTGTGGATTACCACAGTGGTGGCTACTGAATCACCCCCTTCGTCGGGGGAACCCTCCCAAATATTTTTTTG<br>GCAAAGCGAAGCGGGGCGAAATCCCTGGAGTCCTTGCCAAAATCTTAAAACCCTTGTTCTATATTAGTTTCATAAA<br>CTAAGGTGTCAATTGATTTAGTTTTTTCAAATTAGATTGAAGAAGCTTTTTAGCAGCATTGTCAAATTTGTATGCGAA<br>AAGCTTCAGTAACAAGGGTCTAGACGGGCAGAGAAATCCCGGCTAGGGGTGGGTTGAAAGNNNNNNNNNNNNNNNN<br>NNNNNNNNN |
| | LE<br>(SEQ ID<br>NO: 1025) | TTAATATAATAATTATTCAAATCAATAAACACATCACAGCCTTCTAACTTCAAAAACTTCCAAATATCCCCCGTTGTT<br>ACTGCACCATAAATAGTTGTCGAATAACTAATTAAATGTCGTCTTAACAAATTAATGTCGCTCAAAACGTAAAGGCT<br>ATAATCGTTACTAAGCAAGGATTATAGCCTTTTTGATTTCTATTTAGCATTCCTAAATATTTAACTAATTAAACGTCG<br>TAATTTGTAAATATAACAAAATAAGTGTCGTTTTTTCAAAAAATCTCTTTCCAAAGTTTTTAACGGCTCATAACAAA<br>ATAAGTGTCGTCTTTTGGAAGTGAGTAAAAAATCTAAAATTACGTGTCGCTTTTTGGAATAAAGTAGTAGTATATTT<br>ACTAGGTAATAGTAATTATGTACGAATAAGGTGTTACGCATTTAATTTTTTGCCCAAAAGCCTTGCAGCAAGGACT<br>TTAGGCTGCAAAATATTACATTTAGATGCGCGTCAGCTTACAAACATAGTTGTACTCAAGTCTTCTTATTTCTCTA<br>CTTGCAAAGTCATTCCTCATATTGCGTTAAAGGTTGATGTGAGTTGAGGCTGTATACT |
| | RE<br>(SEQ ID<br>NO: 1026) | GGTTCAACGACCATCCCGGCTAGGGGTGGGTTTAAACGACGGGAAGAGCAAATCTGTTACTGCTGTATGCAGCAAG<br>GTTTCAACAACTATCCCGGGTCAAGTTTGCTTGTGAGGGTTGAAAGGAATGTCACCTTCCCAATACTAGAAGAGTGT<br>CAAAAGCTATGCTGGCTAATGGAAGGTTGAAATTAATCGCTATTTTTTGCAAAGAAAAGATTCTACCAGTTATAAA<br>AAAGCAAGAGTGACAAACAATTAGTCGTTCAAACAAATGACAAATTGTTTGTCGCTCTAAAGTATCCTAGATTACTT<br>GACTATACGAGTTTATTTTTAGGGATTAAGCTCGGGGAAAAGTTTGTGATCTACTGACATTCAAGTAACACTGACA<br>AATAATTTGTCACTGTACAATACTCAATAAGAGTCGGCTACATTAAATGACTATAAGACAAATAATTTGTCGCTTTA<br>CCACTTTTTGACAAATAATTTGTCGCCACGGTCAAATAATTTGTCGCTCTACATTTGAAAGCGGGCGATGGGACTCGA<br>ACCCACGACGTTCACCTTGGGAAGGTGACATTCTACCACTGAATTACACCCGCAAATGGATGTTAGCCT |
| AP018216/<br>Trichormus<br>variabilis<br>NIES-23/<br>T40 | TnsB<br>(SEQ ID<br>NO: 1027) | ATGGTCATCCAGACACTGCTGGAACCCTGCGACAGAACCACCTACGGCCAGAAGCTGAAAGAGGCCGCCGATACAC<br>TGGGAGTGACAGTGCAGACAGTGCAGGCTGGTCAAGAAGTGGGAAGAGGACGGACTCGTGGGCTTTATCCAGA<br>CCGGCAGAGCCGATAAGGGCAAGCACAGAATCGGCGAGTTCTGGGAGAACTTCATCATCAAGACCTACAAAGAGG<br>GCAACAAGGGCAGCAAGCGGATGACCCCTAAACAGGTGGCACTGAGAGTGCAGGCCAAGGCCAGAGAGCTGGGCG<br>ATAGCAAGCCTCCTAACTACCGGACCGTGCTGAGAGTTCTGGCCCCTATCCTGGAACAGAAAGAAAAGACCAAGAG<br>CATCAGAAGCCCCGGCTGGCGGGAACAACACTGAGCGTGAAACAGAGAAGGCCAGGACCTGAGCGTGGACTA<br>CAGCAATCACGTGGCAGTGCGACCACACCAGAGTGGATGTGCTGCTGGTGGATCAGCACGGCGAGCTGCTTTCT<br>GACCTTGGCTGACCACCGTGATCGACACCTACAGCAGATGCATCATGGGCATCAACCTGGGCTTCGACGCCCCTTC<br>TTCTGTGGTGGTTGCTCTGGCCCTGAGACACGCCATCCTGCCTAAGAAATACGGCGCCGAGTACAAGCTGCACTGCG<br>AGTGGGGCACATACGGCAAGCCTGAGCACTTCTACACCGACGGCGGCAAGGACTTCAGATCCAACCACCTGTCTCA<br>GATCGGCGCTCAGCTGGGCTTTGTGTGTCACCTGAGAGACAGACCTAGCGAAGGCGGCATCGTGGAAAGACCCTTC<br>AAGACCCTGAACGACCAGCTGTTCAGCACCCTGCCTGGCTACACAGGCAGCAACGTGCAAGAGGGCTGGAAGATG<br>CCGAGAAGGATGCCAAGCTGACCCTGAGAGAACTGGAACAGCTGCTTGTGCGGTACATCGTGGACCGGTACAACCA<br>GAGCATGCAGAATGGGCGATCAGACCAGATTCGGAACGATGGGAGGCCGGACTGCCTTCTGTGCCTGTGCCT<br>ATCGAGGAACGCGACCTGGACATCGCCTGATGAAGCAGAGCCGCAGAACCGTTCAGAGAGGCGGCTGTCTGCAGT<br>TCCAGAACGTGATGTACCGGGCGAGTACCTGGCTGGATATGCCGGCGAGACAGTGAACCTGAGATACGACCCCAG<br>AGACATCACCACCGTGCTGGTGTACCGGCAAGAGAAGTCCCAAGAGGGTGTTCCTGACCAGAACACACGCCCAGGGA<br>CTCGAGACAGAACAGCTGAGCCTGGATGAAGCCGAGGCTGCCTCTCGGAACTGAGAAATGCCGGCAAGACCGTGT<br>CCAATCAGGCCCTGCTGCAAGAAGTGCTGGAACGGGACGCTATGGTGGCCAACAAGAAGTCCCGGAAAGAGCGGC<br>AGAAGCTCGAGCAGGCCATTCTGAGATCTGCCGCCGTGAACGAGAGCAAGACAGAGTCTCTGGCCAGCAGCGTGAT<br>GGAAGCCGAAGAGGTGGAAAGCACCACCGAGGTGCAGAGCAGCTCTAGCGAACTGAAGTGTGGGACTACGAGCA<br>GCTGCGGGAAGAGTACCGGCTTCTGA |
| | TnsC<br>(SEQ ID<br>NO: 1028) | ATGACCGACGCCAAGGCCCATTGCTCAGCAGCTCGGCGGAGTGAAGCCTGACGAAGAATGGCTGCAGGCCGAGATC<br>GCCAGACTGAAGGGCAAGTCTATCGTGCCCCTGCAGCAAGTGCGGAGCCTGCATGATTGGCTGGACGGCAAGAGAA<br>AGGCCCGGCAGTTCTGTAGAGTCGTGGGCGAGTCTAGAACCGGCAAGACCGTGGCCTGTGACGCCTACAGATACCG<br>GCAGAAAGTGCAGGCTGAAGTGGGCAGACCTCCAATCGTGCCCGTGGTGTATATCCAGCCTCCTCAGAAGTGCGGC<br>GCCAGAGACCTGTTCCAAGAGATCATCGAGTACTGAAGTTCAAGGCCCACCAAGGGCACCGTGTCCGACTTCAGAG<br>GCAGAACCATGGAAGTGCTGAAAGGCTGCGGCGTGGAAATGATCATCGTGGACGAGGCCGATAGACTGAAGCCCG<br>AGACATTTGCCGAAGTGCGGGACATCTACGACAAGCTGGGAATCGCCGTGGTGCTCGTGGGAACCGACAGACTGGA<br>AGCCGTGATCAAGCGGGACGAACAGGTGTACAACCGGTTCAGAGCCTGCCACAGATTCGGCAAGCTGAGCGGCAA<br>GGACTTCCAGGATACAGTGCAGGCTCGGGAAGATAAGATCCTGAAGCTGCCCCTGCCTAGCAACCTGATCAGCAAG<br>GACATGCTGCGGATCCTGACCAGCCGCACAGAGGGCTATATCGGCAGACTGGACGAGATCCTGAGAGAGGCCGCCA<br>TCAGAAGCCTGTCCAGAGGCCTGAAGAAATCGACAAGCCCGTGCTGCAAGAGGTGGCCCAAGAGTACAAGTGA |
| | TniQ<br>(SEQ ID<br>NO: 1029) | ATGGCTGCCCCTGATGTGAAGCCCTGGCTGTTCATCATCCAGCCTTACGAGGGCGAGAGCCTGAGCCACTTCCTGGG<br>CAGATTCAGAAGGGCCAATCCACCTGTCTGCAGCGGCCTGGGAAAACTGGCTGGAATTGGAGCCGTGGTGGCCAGA<br>TGGGAGAGATTCCACTTCAACCCCAGACCTAGCCAGAAAGAGCTGGAAGCCATTGCCAGCCTGGTGGAAGTGGACG<br>CCGATAGACTGGCTCAGATGCTGCCTCCACTCGGCGTGGGAATGCAGCACGAGCCTATTAGCACTGTGCGGCGCCTGT<br>TATGCCGAGGCTCCTTGTCACAGAATCGAGTGGCAGTACAAGAGCGTGTGGAAGTGCGACCGGCACGAGCTGAAGA<br>TCCTGGCCAAGTGTCCCAATTGCGAGGCCCCTTTCAAGATCCCCGCTCTGTGGGAAGATAAGTGCTGCCACAGATGC<br>AGAACCCCTTTCGCCGAGATGACCAAGTACCAGAAGATCACCTGA |

TABLE 27-continued

| Name/Organism/System ID (T) | | Sequences |
|---|---|---|
| | Cas12k (SEQ ID NO: 1030) | ATGAGCCAGAAAACCATCCAGTGCCGGCTGATCGCCAGCGAGAGCACCAGACAGAAACTGTGGAAGCTGATGGCCGAGAGCAACACCCCTCTGATCAACGAGCTGCTCCAGCAGCTGAGCAAGCACCCCGATTTTGAGAAGTGGCGGCGGAACGGCAAGCTGCCTTCTACAGTGGTGTCCCAGCTGTGCCAGCCTCTGAAAACAGACCCCAGCTTTACCGGCCAGCCTAGCCGGTTTTACATCAGCGCCATCCACATCGTGGACTACATCTACAAGAGCTGGCTGACCATCCAGAAGCGGCTGCAGCAACAGCTGGATGGCAAGCTGAGATGGATCGAGATGTTCAACAGCGACGTGGAACTGGTGAAATCAGCGGCTTCAGCCTGGAAGCCATCAGGACAAAGGCCTCCGAGATCCTGGCCATCACCACACCTGAGAGCGACCCCAAGACACTGCTGACCAAGAGAGGCAAGACCAAGCAGTCCAAGAAGTCCAGCGCCAGCAATCCCGACAGAAGCCTGAGCAGAAAGCTGTTCGACGCCTACCAAGAGACAGACGACATCCTGTCCAGATCCGCCATCTCCTACCTGCTGAAGAACGGCTGCAAGCTGAACGACAAAGAGGAAAACCCCGAGAAGTTCGCCAAGCGGCGGAGAAAGGTGGAAATTCAGATCCAGCGGCTGACCGACAAGCTGACCAGCAGAATCCCCAAAGGCCGGGACCTGACCTACAGCAAGTGGCTGGAAACCCTGTTCACCGCCACCACCACAGTGCCCGAGAACAATGCCGAGGCCAAGAGATGGCAGGACATCCTGCTGACAAGAAGCAGCAGCATCCCATTTCCAGTGGTGTTCGAGACAAACGAGGACCTCGTGTGGTCCACCACAGAGAAGGGCAGACTGTGCGTGCACTTCAACGGCCTGAGCGACCTGATCTTCGAGGTGTACTGCAGCAGCAGAGCTGTACTGGTTCAAGCGGTTCCTGGAAGATCAGCAGACCAAGCGCAAGAGCAAGAACCAGCACAGCAGCGGCCTGTTTACCCTGAGAAATGGCAGACTGGCCTGGCAGCAAGGCGAAGGCAAAGGCGAGCCTTGAACATCGGACATCTGGCCCTGTACTGCTGCGTGGACAACAGACTGTGGACAGCCGAGGGCACAGAGCAAGTGCGGCAAGAGAAGGGCCGAGGAAATCACCAAGTTCATCACCAAGATGAAGGACAAGTCCGACCTGAGCGAGACACAGCTGGCCTTCATCAAGCGGAAAGAGAGCACCCTGACCAGGATCAACAACAGCTTCGACAGACCCAGCAAGCCCCTGTACCAGGGCCAGTCTCATATCCTCGTGGGAGTGTCTCTGGGCCTCGAGAAGCCTGCCACAATTGCCGTGGTGGATGCTATCGCCGGCAAGGTGCTGACCTATCGGAGTCTGAGACAGCTGCTCGGCGACAACTATGAGCTGCTGAACAGACAGCGGAGAGGCAGAGATCCCTGAGCCACCGAGAAGACAACAAGGCCCAGAAGTCTTTCAGCCCCAACCAGTTTGGCGCCTCTGAGCTGGGCCAGTACGTTGACAGACTGCTGGCCAAAGAAATCGTGGCTATCGCCCAGACCTACAAGGCCGGTCTATCGTGCTGCCTAAGCTGGGCGACATCCGCGAGATTGTGCAGAGCGAGATTCAGGCCATTGCCGAGGCTAAGTGCCCTAGCAGCTCTGAGATCCAGCAGAAGTATGCCAAGCAGTACCGCGTGAACGTGCACCAGTGGTCCTACGGCAGACTGATCCAGAGCATCCAGTCCAAGGCCGCTCAGATCGGCATCGTGATCGAGGAAGGCAAGCAGCCCATCAGAGGCAGCCCTCAGGATAAGGCTAAAGAACTGGCTCTGTACGCCTACAGCCTGCGGCTGGCCAGAAGATCTTAA |
| | TracrRNA (SEQ ID NO: 1031) | CAAACATCTGAACCTTGAAAATATAATATGTAATAGCGCCGCAGTTCATGCTGCTTGCAGCCTCTGAATTGTGTTAAATGAGGGTTAGTTTGACTGTAGCAATACAGTCTTGCTTTCTGACCCTGGTAGCTGCTCACCCTGATGCTGCTGCCAATAGACAGGATAGGTGCGCTCCCAGCAATAAGGGCGCGGATGTACTGCTGTAGTGGCTACCCAATCACCCCCGATCAAGGGGGAACCCTCCCCAATTCTTGATTTGACGCACCAAAGAGAGGTCAAAATTCCGATCTAGGTTCGCGCACATCCTGAAAACCTTATCCTACAAGGAATTTATGAGTAAATTTCTTTTGTAGACAATTCAAAAATTACATCCTGGGAGGCTATTTGATGAGGTTCGCGCAAATCTGCTTCAAAAACCTTGCTAGACAAGCGTTTCATAGAGTGGCA |
| | DR (SEQ ID NO: 1032) | GTTGCAACCCTCCTTCCAGTAATGGGAGGGTTGAAAG |
| | sgRNA (SEQ ID NO: 1033) | CAAACATCTGAACCTTGAAAATATAATATGTAATAGCGCCGCAGTTCATGCTGCTTGCAGCCTCTGAATTGTGTTAAATGAGGGTTAGTTTGACTGTAGCAATACAGTCTTGCTTTCTGACCCTGGTAGCTGCTCACCCTGATGCTGCTGCCAATAGACAGGATAGGTGCGCTCCCAGCAATAAGGGCGCGGATGTACTGCTGTAGTGGCTACCCAATCACCCCCGATCAAGGGGGAACCCTCCCCAATTCTTGATTTGACGCACCAAAGAGAGGTCAAAATTCCGATCTAGGTTCGCGCACATCCTGAAAACCTTATCCTACAAGGAATTTATGAGTAAATTTCTTTTGTAGACAATTCAAAAATTACATCCTGGGAGGCTATTTGATGAGGTTCGCGCAAATCTGCTTCAAAAACCTTGCTAGACAAGCGTTTCATAGAGTGGCAGAAATTCCAGTAATGGGAGGGTTGAAAGNNNNNNNNNNNNNNNNNNNNNNN |
| | LE (SEQ ID NO: 1034) | CTGGCATTCTTACTAATGCAGCAAACCTCACTCAGCCTGACCAAGTTGCCTCTTTGTGCGCTTGGTTTATTCAACTTTGATGTACAGTGACTAATTATTTGTCACTGTACACAAGATGTACAGTGACTAATTATTTGTCACTGTACACAAGATGTACAGTGACTAATTGTTTGTCGTCGTGACAAATTAATGTCGTGAATGAATCCTTGCAATACAAAGGTTTTAGCTATTTAAGAGTTATTACATTATTTCTCATACGTGACTAAATAAATGTCGTTTTCCGCAAAAATGACAAATTAACTGTCGCTTCAGTAATTACAAAAAAGGTTTTGTATATTTTCATAATGACAAATTGACTGTCGTTTTCTCCACGTTTAGAATAACATTATGTATTTATAAATTACCTTTGTTTCATGAACAAAAAATCTTATGTCTGATTTTACTGTTCATACCGCAGTGGATACTGCGGAAGCTTTATTACAAGACAACAACACCTC |
| | RE (SEQ ID NO: 1035) | GTTGCAACCCTCCTTCCGGTAATACATGGTGAAAACAAATTGGATATGAAACTGCCTTACGTTGTCTGATGGTGTAATTAATTTCCAAGAAGTAGAGGGTTGAAAGCAAATCCCGTCATCGGCTTGTAACTAAAGTTATTCAGGATAAGCTACTCATAGAAGTGATTAAAAGAGCTTTTTGAATGCAAACGCTTATAATAGGGGCTAAATATATAGAGAAACTCCATATATAAATTGTTGCTTTTCCGAAAAATGACAATAATTTGTCACCGACGTGACAAATAAGAGACCATTTATAAAGTAAATCTTTAGACGACTAGACGACGTAGCATAATACGAGTCATAACGGCATATATGGCAGCCTCACTCATTTCTGGGAGACGCTCATAATCCTTACTGAGACGACGGTACTGGTTTAACCAGCCAAATGTTCT |
| AP018227/ Calothrix parasitica NIES-267/ T41 | TnsB (SEQ ID NO: 1036) | ATGGGCGAAGATTACCCCAGCGACAGCCTGGAAAGCGAGACAAACGAGATCGTGACCGAGCTGAGCTACGAGGAACGCAGAGTGCTGGAAGTGATCCAGGGCCTGCTGGAACCCTGCGACAGAAAGACATACGGCGAGAAGCAGAGCAGGCCGCTGCCAAGCTGGGAAAGTCTGTCGGACCATCAGACGGCTGGTCAAGAAGTGGGAAGAACAGGGACTTGCCGCTCTGCAGACCACCACCAGAGTGGATAAGGGCAGACACCGGATCGACAAGGACTGGCAGGACTTCATCATCAAGACCTACAAAGAGGGACAACAAGGGCAGCAAGCGGATCAGCCCCTCTGCAGGTTTCATGAGAGTGAAAGTGCAGGACGTCTGAGCTGGGCCAGAAAGAGTACCCTAGCTACCGGACCGTGACAGGGTGCTGCAGCAGTCTGATTGAGCAGCAAGAGCAGAAAGCCAAAGTGCGGAGCAGAGGCTGCGGGGATCTAGACTGCTGGTTAAGACCAGAGAGGGCAAAGACCTGAGCGTGGAATACTCCAACCACGTGTGGCAGTGCGATCACACCCTGGTGGATCTGCTGCTGGTGGATAGACACGGCGAGATTGTGGGCAACCTTGGCTGACCACCGTGATCGATACCTACAGCCGGTCATTGATGGGCATTGACTGGGCTTCAATGCCCCTAGCTCTCAGGTGGTGGCTCTGGCCCTGAGACACGCCATTATGCCCAAGCACTACAGCAGAGTACGAGCTGTACGAGGAATGGGCACCTATGGCAGCCCCGAGCACTTTTACACAGACGGCGGCAAGGACTTCAGAAGCAACCATCTGCAGCAGATTGGCGTGCAGCTGGGCTTCGCCTGTCACCTGAGAAACAGACCTAGCGAAGGCGGCATCGTGGGAAAGACTTCGGCACCCTTCAACACCGAGTTCTCATCCTGCCTGGCCACACCGGCAGTGCAGCAGAGGCCTAAAGAGGCCGGAAAAGAGGCCTGCGTCACCCTGAGAGAGCTGGAAAAGCTGCTCGTGCGGTTCATCGCGGACAAGTACAACCAGAGCATCGACGCCAGAAGCGGCGACCAGACCAGATTCAGAGATGGGAGGCCGGACTGATCGCCGTGCCTAACATGATCAGCGAGCGCGACCTGGACATCTGCCTGATGAAGCAGACCAGACGGACCATCTACCGCAGCGGCTACATCCAGTTCGAGAACCTGACCTACAAGGGCGAGAACCTCGGAGGATACGCCGGCGAAAATGTGGTGCTGAGATACGACCCCAGAGACATCACCACCGTGTGGGTGTACAGACGGAAGGGCTCCAAAGAAGAGTTCCTGGCCAGA |

TABLE 27-continued

| Name/<br>Organism/<br>System<br>ID (T) | Sequences |
|---|---|
| | GCTTTCGCCCAGGACCTGGAAACCGAACAGCTGTCTCTGGATGAGGCCAAGGCCAGCTCCAGAAAAGTTCGCGAGG<br>CCGGCAAGACCGTGTCCAACAGATCTATCCTGGCCGAAGTGCGGGACAGACAGATCTTCACCACACAGAAAAAGAC<br>CAAGAAAGAGCGGCGCAAGACCGAGCAGGCCGAACTGATTCAGGCCAAGCAGCCACTGCCTGTGGAACTGGAAGT<br>GGAAGAAGAGGTGGAAACCGTCAGCACCGGCTCCGAGCCTGAGTATCAGATGCCTGAGGCCTTCGACTACGAGCAG<br>ATGAGAGAGGACTACGGCTTCTGA |
| TnsC<br>(SEQ ID<br>NO: 1037) | ATGACCAATCAGCAGGCACAGGCAGTTGCACAGCAGCTGGGTGCAATTCCGACCAATAATGAAAAACAGCAGGCA<br>GATATTCAGCGTCTGCAGGGTAAAAGCTTTGTTCCGCTGGAAAAAGTTAAAGTGCTGCATAATTGGCTGGAAGGTA<br>AACGTCAGAGCCGTCTGAGCGGTCGTGTTGTTGGTGAAAGCCGTACCGGTAAAACCATGGGTTGTGATGCATATCGT<br>CTGCGTCATAAACCGATTCAGAAACATGGTAAACGCCTACCGTTCCGGTTGTTTATATTCAGATTCCGCAAGAATG<br>TGGTGCCAAAGACCTGTTTAGCATGATTATCGAACATCTGAAGTTTCAGCTGGATAAAGGCACCGTTGCAATTTTTC<br>GTAATCGTGCATTTGAAGTTCTGGAACGTTGTGCAGTTGAAATGGTGATTATTGATGAAGCCGATCGTCTGAAACCG<br>AAAACCTTTGCCGAAGTTCGTGATATCTTTGACAAACTGCAGATTCCGGTTATTCTGGTTGGTACAGATCGTCTGGA<br>TGCAGTTATTAAACGTGATGAACAGGTGTATAATCGTTTTCGTGCATGTCATCGTTTTGGTAAACTGAGCGGTGAAG<br>ATTTTAAACGCACCGTGGAAATTTGGGAAAAGCAGATTCTGAAACTGCCGGTTGCAAGCAATCTGAGCAGCCCGAA<br>AATGCTGAAAATTCTGGTGGATGCAACCGGTGGTTATATTGGTCTGCTGGATATGATTCTGCGTGAAGCAGCAATTC<br>GTGCACTGAAAAAAGGTCTGCAGAAAATCGATCTGAAAACCCTGAAAGAAGTGACCGAAGAGTACAAATAA |
| TniQ<br>(SEQ ID<br>NO: 1038) | ATGCAGGCCGAGAACATCCAGCCTTGGCTGTTCAGAGTGGAACCCTGGAAGGCGAGAGCCTGTCTCACTTCCTGG<br>GCAGATTCAGACGGGCCAGCTACCTGACAGTGTCCGGCCTGGGAAAGAGGCCGAACTTGGCGGAGCTGTGGCCAG<br>ATGGGAGAAGTTCAGATTCAACCCTCCACCTAGCCGGCAGCAGCTGGAAAAACTGGCCGCTGTCGTGGGAGTCGAC<br>GTGGACAGACAGTTGGTTCTGATGCTGCCTCCTTCTGCGGTGGGCATGAAGATGGAACCCATCAGACTGTGCGGCGCCTG<br>TTACGCCGAAAGCAGCTGCCACAAGATCAAGTGGCAGTTCAAGACCCGGCAGGGCTGCGACAGACACAAGCTGAC<br>ACTGCTGAGCGAGTGCCCCAATTGCGGCGCCAGATTCAAGATCCCTGCTCTGTGGGTGGACGGCTGGTGCCACAGA<br>TGCTTCACCCCTTTCGAGGAAATGGTCAAGTTCCAGAAGGACATCAACACCGACTGA |
| Cas12k<br>(SEQ ID<br>NO: 1039) | ATGAGCTTCAAGACCATCCAGTGCCGGCTGGTGGCCGAGGAATCTACAAGACAGCAGCTGTGGCAGCTGATGGCCC<br>ACAAGAACCCCTCTGATCAACGAGCTGCTGCTGCAGGTTGCCCAGCATCTGACTTTGAGACATGCGGAAGAA<br>GGGCAAGATCGCCAAGGGCATCATCACCCAGCTGTGCCAGAGCCTGAAAACCGACCTGCCGGTTTATCGGCCAGCCA<br>GGCAGATTCTACACCAGCGCCATCACCTTCGTGGACTGCATCTACAAGTCCTGGCTGGAACTGATGAAGCTGAACCA<br>GCGGCGGCTGGAAGGCAAGAACAGATGGCAGAAGATGCTGAAGTCCGACGCCGAGCTGGTGGAAGATAGCAGCGC<br>TAGCCTGGACCTGATCAGAAGCAAGGCCACCGAGATTCTGGCCCAGGCTCAGCTGAATAGCGAGAGCCTGAGCGCC<br>GAGAATCAAGAGACAACAAGAGCGAGAGTCCATCAAGAAGCAGAAGAAGGGAAAAAGAAAACAACAAAAA<br>GTCCGAAGAGTCCGAGGAAAACAAGTCCCTGAGCAAGGCCCTGTTCGACGCCTACGAGAACACCGAGGACATCCTG<br>ACCAGATGCGCCATCTCCTACCTGCTGAAGAACGGCTGCAAAGTGACCAACAAAGAAGAGGACCCCGAGAAGTTCA<br>CCATCCGGCGGAGAAAGCTGGAAATCGAGATCGAGGACCTGCAAGAGAAGCTGGAAGCCAGACTGCCCAAGGCCA<br>GAGATCTGACCGATAGCAGCTGGCTGAACAACCTGGAACTGGCCACCAAACAGGTGCCCGAGTCTGAGGAAGAGG<br>CCAAGTCTTGGCCAGGACGCCCTGCTGAAAAGTCCAGCAGCGTGCCCTTTCCAATCGCCTATGAGACAAACAGAGGA<br>CATGACCTGGTTCAAGAACGAGAAGGGCAGAATCTGCGTGAAGTTCAACGGCATCGGCGAGCACACCTTCGAGATC<br>TACTGCAACAAGCGGCAGCTGCACTGGTTTAAGCGGTTTCTGCTGGACCAAGAGACTAAGAAGAACAGCAACGACC<br>AGTACAGCAGCTCCCTGTTCACCCTGAGAAGCGGCCTGATCCTGTGGCAAGAGCGGGACAAGAAAGGCAAGCCCTG<br>GAACATCAACTATCTGGCCCTGCACTGCTGCGTGGACACCAGACTTTGGACAGCCGAGGGAACACAGGTGGTGGCT<br>GAAGAAGAACGCCGAAGAGATCACCCGGATCATCGACAACGCCAAGAAGAAGGACAACCTGAACAAGAACCAGCTG<br>ACCTTCATCAAGCGGAAGAAAACCACACTGGCCCGGATCAACAACCCCTATCCTAGACCTAGCAAGCCCCTGTACA<br>AGGGCCAGAGCAACATCATCCTGGGCCTGTATCTGGGCCTGAAAGAGCGGGCCACAATCGCCGTGGTGGATGTGAA<br>TGCCGGCAAGGTGCTGATCAACCAGAGCACCAAGCAACTGCTGGGAAACAACTACCGGCTGATCGACCGGCAGCG<br>GAGACAGAAGAGAAACTGAGCCACCAGCGGAAGATCGCCCAGACACAGAGCAAGCCCAACAACTTCAAAGAGA<br>GCGACCTGGAGTACATCGACAGACTGCTGGCCAAAAAGATCGTGAAATTGCCCAGAAGTTCAGCGCCAGCAG<br>CATCGTGCTGCCCAAGCTGACCAACATGAGAGCAGATCAACAGCAGATCCAGGCCAAGGCCGAGAAGAAGTG<br>CCCTGAGTCTATCGAGGTGCAGAAGAAATACGCCCACCAGTACCGGATCAATCTGAACAACTGGTCCTACGCCGG<br>CTGACCCAGAACATCCAGAATCTGGCCTCTCAAGTGGGCCTGACCGTGGAAGAGAATGAGCAGCCTCTGAAGGGCA<br>GCCCCAAAGAGAAAGCCAAAGAACTGGCCCTGGTGGCCTACAAGGCCCGGAACAAATCTTGA |
| TracrRNA<br>(SEQ ID<br>NO: 1040) | TCATCAAAGACCCAATATTTAAAATAGAGTAATAAATAGCGCCGTTGTTCATATGAACAATGCTAAATGCGGGTTA<br>GTTTGACTGTGAGACTACAGTTTTGCTTTCTGACCCTAGTAGCTACCCACCTTGAAGCTGCTATCTCTTGTAGGTAGG<br>ACATCAGGTGCGCCCCCAGTAATAGAGGTGCGGGTTTACCGCAGTGGTGGTTACCGAATCACCTCCGAGCAAGGAG<br>GAACTCACCCTTAATTTTTATTTTTGGCACATCGAAGCGGGGGTTATTTTCCTGGTACTTCTGTCAAAATCTTTAAAT<br>CCTTATCTATCAATAATTTTGGCTTTCATAGTGTCAAGCAATTTACTTTTTTAAGTATTAGATGACAGGTGATTTTGA<br>TAGACCTGCCAAAAATGCTTTTAAAAGTCTTGGTAAGTAAGGGGTTGAAGGTACGGG |
| DR<br>(SEQ ID<br>NO: 1041) | GTTTCAAAGCTCTTTCTGGCTTTGAGCGAGTTGAAAG |
| sgRNA<br>(SEQ ID<br>NO: 1042) | TCATCAAAGACCCAATATTTAAAATAGAGTAATAAATAGCGCCGTTGTTCATATGAACAATGCTAAATGCGGGTTA<br>GTTTGACTGTGAGACTACAGTTTTGCTTTCTGACCCTAGTAGCTACCCACCTTGAAGCTGCTATCTCTTGTAGGTAGG<br>ACATCAGGTGCGCCCCCAGTAATAGAGGTGCGGGTTTACCGCAGTGGTGGTTACCGAATCACCTCCGAGCAAGGAG<br>GAACTCACCCTTAATTTTTATTTTTGGCACATCGAAGCGGGGGTTATTTTCCTGGTACTTCTGTCAAAATCTTTAAAT<br>CCTTATCTATCAATAATTTTGGCTTTCATAGTGTCAAGCAATTTACTTTTTTAAGTATTAGATGACAGGTGATTTTGA<br>TAGACCTGCCAAAAATGCTTTTAAAAGTCTTGGTAAGTAAGGGGTTGAAGGTACGGGAAATTCTGGCTTTGAGCG<br>AGTTGAAAGNNNNNNNNNNNNNNNNNNNNNNNN |
| LE<br>(SEQ ID<br>NO: 1043) | CACTTTGCAAGTAGATGAGGTACATTCTTTTTTGCTCGCTACTCGCTACTTGCTACTCGCTACTCGCTAC<br>TCGCTACTTGCTACTTGCTACTCCCTCAAATGATTAGGTGTAGCTCACTTGGATGATGTCGTTTGCCAAATTAAATGA<br>CCACTTGACAAATTAATGTCCTTAAAAATATTTATTCCAAAACCTTTGCAATGCAAGGGTTTATTGTTTTAAGCCTC<br>TTCGAGATACAAATAAGGTTATTGACAATTAAGTGTCCTCTTTTGGGACTTTGACAAGTTATTTGTCCTTTCTTGAA<br>AACAAGGCTTTGACTGAAAACTTTACCTAACTTGACAAAATAAATGTCTTCTAACGTTAAAATACAATTATGTTTTAT<br>TAGGCAATTAGGTTTATTATGGGTGAAGATTATCCCAGTGACTCATTAGAGTCAGAAACCAACGAGATTGTGACGGA<br>ACTTTCCTATGAAGAAAGGCGTGTTTTAGAAGT |

TABLE 27-continued

| Name/<br>Organism/<br>System<br>ID (T) | | Sequences |
|---|---|---|
| | RE<br>(SEQ ID<br>NO: 1044) | GTTTTAACGCATTTTCAGACTTTGGGCTAGTTGAAAGCTGCATTACTAATGAGTGTAAAAAGTCTTGCTCAATGCAC<br>TTGGCACTTTCAAGCTTTGGGCAAGTTAAAAGAAGCTTGATAGTGAGATACGTGCAATTCTTTCTTAGGTTTCAACTT<br>TCTTTCACGCTTTGGCAGGTTGAAGGAAAGCCAATGCAATCGAAAACAAGTAATTAAGTTTTAATATAAAATAAAC<br>AATAGGTGAGTGGAAAGCGAATCCAGTTACGTCCTAAGCGAATGATTTGAAGCATTCGTGGTTGATTTATATATATA<br>TTTAAATCAATTCAGAGGACATTAATTTGTCAACGCGGACACTAATTTGGCAAAACGGACATTAATCTGGCAACGCG<br>GTCAAATAATGTGGCAAGTGACATCACACAACAGACAATGTTAATTATTTCAAAAAAATGGACGTAACTGGATTCG<br>AACCAGTGACCTCTACGATGTCAACGTAGCGCTCTAACC |
| AP018248/<br>Tolypothrix<br>tenuis<br>PCC 7101/<br>T42 | TnsB<br>(SEQ ID<br>NO: 1045) | ATGCCCAGAAAGCCTACCAGCGAGGCCTTTCCTGGCCTGGAAATTGAGGAAGCCGCCAATCAAGAGGAAGAACAG<br>ACCAAGCACCTCCTGGTCAACGAGGACAGCAGCGACTACCTGAAGAAGGTGGAACTGATCGACGCCATCCGGCAG<br>GCCCCTAACAAAGCCGCTAGAATGGATGCCATTGCCGACGCCGCTAAGGCCCTGGGCAAGAGCACAAGAACCATCA<br>AGCGGATGGTGGAAAAGGTCGAGCAAGTGGGCGTTGCCACACTGGCCGTGGGCAGAAAAGATAAGGGCCAGTACC<br>GGATCAGCCAGCAGTGGCACGACTTCATCGTGAACCTGCACAAATGGGGCAACAGAGAGGGCAGCAGAATCAACC<br>ACAACCAGATCTTCGGCTATCTGAAAGCCCTCGCCAGCCAGGGCGAAAAGCTGCTGCACAAGAAGCACGACGAGA<br>AGTTCAAAGAGTACAGCCAAGTCCGCGAGGACCTGGTGGCTGGAACACACCCTTCTCACGTGACCGTGTACAAGAT<br>CATCAACAGCTACCTCGAGCAGAAACACAAGACCGTGCGGCACCCTGGAAGCCCTATCGAGGGACAGATCATCCAG<br>ACCACCGAGGGCATCCTGGAAATCACCCACAGCAATCAGATCTGGCAGGTCGACCACACCAAGCTGGACATCCTGC<br>TGATCGATGAAGAGGACAAGAAAGTGATCAGCCGGCCTTACATCACCCTGGTCATGGACAGCTACAGCGGCTGCGT<br>GACCGGCTTCTATCTGGGATTTGAACCAGCCGGCAGCCACGAAGTTGGACTGGCTCTGAGACACGCCATCCTGCCTA<br>AGCACTACGGCACCGAGTACGAGCTGCAGGACACCTGGCAGATCTACGGCATCCCCGAGTACATGGTCACCGACCG<br>GGCCAAAGAGTTCAAGAGCGAGCACCTGATCCAGATCAGCCTGCAGCTGGACTTCAAGCGGCGGCTGAGAGCTTTT<br>CCACAAGCCGGCGGACTGATCGAGACAATCTTCGGCACCATCAACCAGCAGATCCTGAGCCTGTACGGCGGCTACA<br>CAGGCAGCAGCGTGGAAGAAAGACCTCCTGAGGCCGAGAGAACCGCCTGTCTGACACTGGACGACCTGGAAAAGA<br>TCCTCGTGCGGTACTTCGTGGACAACTACAACCGGCACGACTACCCCAGAGTGAAGAACCAGAAACAGGATCGAGCG<br>GTGGAAGTCCCGGCTGCTGGAAGAACCTGAGATCCTGGACCAGAGAGAGCTGGATATCTGCCTGATGAAGGTCGCC<br>ATCAGAAACGTCGAGAAGTACGGCAGCGTGAACTTCCAAGGCTGGGTGTACCAAGGCGACTGGCTGCTGAACTACG<br>AGGGCAAACAGGTGTCCCTGAGATACGACAAGCGGAACATCACCAGCGTGCTGGCCTACACCAGACCTATCAATGG<br>CGAGCCCGGCAGTTCATCGGAGTGATTCAGGCCAGAGACTGCGAGCGCGAGAGAATGTCTCTGGCTGAGCTGAAT<br>TACATCAAGAAGAAGCTGCGGGACGCCTGCAAAGAGGTGGACAACAGCTCCATCCGTGAACGGCGGCTGAGCACC<br>TTCGAGGACGTGGAACAGAACCGGAAAGAGCGGCGGAGACACAGAAGAAAAGGCCCAGCAAAAGCACGAGGC<br>CAAGAGCAACAAGTCCAAGATCGTGGAACTGTTCCCCGAGAACCTGACCACCGAAGAGATCATTAACTCCCAAGAG<br>AACCTCACCAGCAACTTCGACGTGAACGCCAAGAACATCGTGAATAGCATCGACAAGCAGATCACCCAGAACAAGC<br>CCAATCCTAACCAGACCAGCAAGGCCAGACGCAGACCTAGAGTGGGCGAGAAGGACTGGAACCAGTTCCTGGAAA<br>ACAACTGGTGA |
| | TnsC<br>(SEQ ID<br>NO: 1046) | ATGAGCGAGATCAACCTGGCCAACGCCAACCTGGAATTTCAGAACAGCTACGACGCCAGCCTGCAGAGCGCTGAGG<br>AACTGAGAAGAAGCCCTGAGGCTCAGGCCGAGGTGGAAAGAATCGGCAAGGCCAACACCTACCTGCCTCTGGACA<br>GAGACACCGAGCTGTTCGACTGGCTGGACGATCAGAGGGATGCCAACGCTGTGTGGCTACGTGACAAGCGCCAGG<br>CTCTGGACTGCTGAAAGCCTGCCAGCTGTACAGAACCCAGTACGTGAAGCGGAGAGGCACCCTGCTGGAAATCCCT<br>GCCACAGTGCTGTACGCCGAGATCGAACAACGGCGGACCCACCGATCTGTACTGCAGCATCCTGGAAGAGATCG<br>GACACCCTCTGGCTCACGTGGGCACACTGAGAGATCTGAGATCTAGAGCCTGGGGCACCATCAAAGGCTACGGCGT<br>GAAGATCCTGATCATCGGCAACGCCGACTACCTGACTACTGGAGAACCGGCCTTCAACGAGCTGATCGACGTGTTCACCAAG<br>ATGCGGATCCCCGTGATCCTCGTGGGCACCTACTACCTGGGCGACAATATCCTGGAACGGAAGTCCCTGCCTTACGT<br>GCGGGTGCACGACAGCTTTTCTGGAAAGCTACGAGTTCCCCAACCTGAACGAAGAGGAAGTGATCGAGGTCGTCAAC<br>GACTGGGAAGAGAAGTTCCTGCCTGAGAAGCACCGGCTGAATCTGACCCAGATGGAAAGCGTGGTGTCCTACCTGC<br>GGCTGAAGTCTGGCGGACTGATCGAGCCTCTGTACGACCTGCTGCGGAAGATCGCCATCCTGAAGATCGACGAGCC<br>CCACTTCGAGCTGAACCAGTACAACCTGACCAAGAGATTCGGCAGACGGAAAGAACCCAAAGTGAAGTTCAAGCG<br>GAAGTCCTGA |
| | TniQ<br>(SEQ ID<br>NO: 1047) | ATGGAACCTGAGGTGCTGCAGAACCCTCCTTGGTACATCGAGCCCAAAGAGGGCGAGAGCATCAGCCACTACTTCG<br>GCAGATTCAGACGGCACGAGGCCGTGTGTGTTGGACTCTCCTGGCACACTGTCTAAGGCCGTTGGCATCGGACCTGTG<br>CTGGCCAGATGGGAGAAGTTCCGGTTCAACCCATTTCCTAGCCAGAAAGAGCTGGAAGCCATCCGCAAGCTGATCG<br>GCCTGGACGCCGATAGAATTGCCCAGATGCTGCCTAGCAAGGGCGAGAAGATGAAGCTGGAACCTATCCGGCTGTG<br>CGCCGTGTGTTATGCCGAACAGGCCTACCACAGACTGGAATGGCAGTTCCAGAGCACCGTGGGCTGCGACAGACAC<br>AAGCTGAGACTGCTGAGCGAGTGCCCCTTCTGCAAGAGAGAGATTCGCTATCCCCGCTCTGTGGGAGCAGGGCGAGT<br>GTAACAAGTGTCACACCCCATTCCGGTCCATGAAGAAGCGGCAGAAGGCCTACTGA |
| | Cas12k<br>(SEQ ID<br>NO: 1048) | ATGAGCCGGGACAGACAGAAGAAGTCCACCTCTCCTATCCACCGGACCATCCGGTGTCATCTGCACGCCTCTGAGG<br>ACGTGCTGCGGAAAGTGTGGGAAGAGATGACCCAGAAGAACACCCCTCTGATCGTGCAGCTGCTGAAGTCCGTGTC<br>TGAGCAGCCTGAGTTCGAGGCCAATCAAGAGAAGGGCACCATCAGCAAGAAAGAGATCACCAAGCTGCGGAAGGC<br>CCTGACCAACGACAGCAGCGATATCCAGCAGCAGGCGGCAGACTGGGAAGCTCTGCCGATTCTCTGGTCACCGAGGTG<br>TACACAAGCTGGCTGACCCTGAGCCAGAAGATCAAGACAGAAGAGGGCAAAGAGTACTTCCTGAACAACATC<br>CTGAAGTCTGACGTCGAGCTGGTGGAAGAGAGCAACTGCGACCTGCAGACCATCGATGCAAGGCCCAGGACATCC<br>TGTCTCAGCCCAAAGAGTTCCTGGAAAAGATCATCAACAACGACGCCGTGCTGAACCAGACCAAGAGCGCCAGAAA<br>GAAGGTGCAGAACAGCAGCAACGATATCAACGCCAGCAGTCCAGACAGTCGACCAGTCTGAAAGAAACGTGG<br>ACAAGAACATCCCTCAGACGCTGACCGAGATCCTGTACAGATCCACAAGATCACGCAGGACATTCTGACCCAGTG<br>CGCCGTGGCCTACCTGATCAAGAACCACAACCAGGTGTCCGACATCGAAGAGGACATCAAGAATCTGAAGAAGCG<br>GCGGACCGAGAAACAGGTGCAGATCAAGCGGCTGGAAGAACAGATTCACAACAAGAAGCTGCCCAACGGCCGGGA<br>CATCACCGGCAGGATACAACCAGGCCTTCGACAATCTGATGGCCCCAGGACAACGAGGAATTCGCC<br>GAGTGGATCGCCAGCCTGAGCACCAAAGTGTCCCATCTGCCTTATCCTATCGACTACCTGTACTCCGACCTGACCTG<br>GTACAAGAACGAGCAAGAGAAGATCTGCGTGTACTTCAACGGCTGGGCAAGTTCCACTTCCAAATCTGCTGCAAC<br>AAGCGCCAGCTGCACTTCTTCAAGAGCTTTCTCGAGGACTACAAGGCCCTCAAAGAGAGCGAGAAGGGCGAGACAA<br>AGCTGAGCGGAAGCCTGGTCACACTGCGTCTGTTCAGCTGCTGTGGCAACAAGGCGAAGGTGCTGGACACAGAAGATGTGCGG<br>GAAAGTGAACAAACTGGCCCTGCACTGCACCTACGACGCCAGACTGCTTACAGCCGAGGGCACAGAAGATGTGCGG<br>CAAGAGAAAACCGACACGACCCAGAAACAAGTGACCAAGGCCGAGGCCAACGAGAACATCGATAGCGACGAGCA<br>GAAGAACCTGAACCGGAACATCAGCTCCCTGAGCCGGCTGAACAATAGCTTCGCCAGACCTAGCAAGCCCATCTAC<br>AGAGGCCAGAGCAACATCATCGTGGGCGTGTCCTTCCATCCTGTGGAACTCGTGACACTGGCCGTGGTGGACATCAT<br>CACCCAAAGAGAAAATCATCTGCAAGACCGTGAAACAGCTGCTGGGCGACGCCTTTAGCCTGCTGTCTAGAAGGCGG |

TABLE 27-continued

| Name/Organism/System ID (T) | | Sequences |
|---|---|---|
| | | AGGCAGCAGGTCCACTTCCGGAAAGAGAGAAAGAAAGCCCAGAAAAAGGACAGCCCCTGCAACATCGGCGAGTCT<br>CAGCTGGGCGAGTATGTGGATAAGCTGCTGGCCAAGCGGATCGTGGAAGTGGCCAAAGAGTATCAGGCCATCTGCA<br>TCGTGCTGCCCACACTGAAGGACACCCGCGAGATCAGAACCAGCGTGATCCAGGCCAAAGCCGAGACTAAGTTCCC<br>CGGCGACGTTAACGCTCAGCAGCTCTACGTGAAAGAGTACAACCACCAGATCCATAACTGGTCCTACTCTCGGCTGC<br>AAGAGAGCATCAAGAGCAAGGCCGCCGAGCTGAAGATCAGCATCGAGTTCAGTATTCAGGCCAGCTACGACACCCT<br>GCAAGAGCAGGCCATCAATCGGCCCTGAGCGCCTACCAGTGCCGGATCAATACCATCGGCAGATGA |
| | TracrRNA<br>(SEQ ID<br>NO: 1049) | AATTTCTACCTAAATATTGTATTGTCTTTTATATTAAATCGGTGCCGTCATATATATATGCTCTTTCGAGAGTTAACT<br>ATATATGACGCGACAGTGTCAGCCCCTTTGTGTAGATACTGTGGAATGGGTTAGTTTAACGCTTGTACAAGCGTATT<br>CTTTCTGACCCTGGTAGCTGCCAACTCAACCTGTGCGTTCATCTAAGCGTTTGTTAGCAGTAATTGCTTGGGTAAGCA<br>AATGCTGCTGTTAGATGAGAAAGGACTCGCACCGAGACGCATGGGAAGTATAAGGTGTTAGGGTGACAAACAGCCC<br>AGAACCTTAGCTCTTGACATCAAACTCTTTTTGCTTGGTGTTAGGTGACAGAGCGGACTATATGACTGAAATCTGGG<br>ATTTTGGTTGTATGAGTACATCATTACCTCTTACTTTACAGCAAAGTAAGGGTACGGGTATACCGTCATGGTGGCTA<br>CCGAACTACCACCCCCTAATTTTTATTTTTGGCAAGTCAAAGCAGGGGCAAAATCCCTGGAGTGCTGCCAAATGGCT<br>AAAACTATTGTCTTGACTGCATTTCATTCATTTCAATGCGAATGCAAGTTTATTTGTTAGTGATAGAAAATAGGCTTT<br>TAAGTAGACTTGCCAAAATCGCTTCTGGAAAATAGTCAGGATAAGAGTTTGACAAGTGCGGG |
| | DR<br>(SEQ ID<br>NO: 1050) | GTTTCAATAACCCTCACGGCTGGTGGTGGGTTGAAAG |
| | sgRNA<br>(SEQ ID<br>NO: 1051) | AATTTCTACCTAAATATTGTATTGTCTTTTATATTAAATCGGTGCCGTCATATATATATGCTCTTTCGAGAGTTAACT<br>ATATATGACGCGACAGTGTCAGCCCCTTTGTGTAGATACTGTGGAATGGGTTAGTTTAACGCTTGTACAAGCGTATT<br>CTTTCTGACCCTGGTAGCTGCCAACTCAACCTGTGCGTTCATCTAAGCGTTTGTTAGCAGTAATTGCTTGGGTAAGCA<br>AATGCTGCTGTTAGATGAGAAAGGACTCGCACCGAGACGCATGGGAAGTATAAGGTGTTAGGGTGACAAACAGCCC<br>AGAACCTTAGCTCTTGACATCAAACTCTTTTTGCTTGGTGTTAGGTGACAGAGCGGACTATATGACTGAAATCTGGG<br>ATTTTGGTTGTATGAGTACATCATTACCTCTTACTTTACAGCAAAGTAAGGGTACGGGTATACCGTCATGGTGGCTA<br>CCGAACTACCACCCCCTAATTTTTATTTTTGGCAAGTCAAAGCAGGGGCAAAATCCCTGGAGTGCTGCCAAATGGCT<br>AAAACTATTGTCTTGACTGCATTTCATTCATTTCAATGCGAATGCAAGTTTATTTGTTAGTGATAGAAAATAGGCTTT<br>TAAGTAGACTTGCCAAAATCGCTTCTGGAAAATAGTCAGGATAAGAGTTTGACAAGTGCGGGAAATCACGGCTGG<br>TGGTGGGTTGAAAGNNNNNNNNNNNNNNNNNNNNNNNN |
| | LE<br>(SEQ ID<br>NO: 1052) | TCAAAATGGTAATCAAGAAACTTTAGATAGCACTGCAACTGTAGAAATGAAACCTGGAGATGTATTTGTGATAGAA<br>ACTCCAGGCGGAGGAGGATTTTTTAAGAGTTTTGAGGAGTAAGATTTGAGTAATGAAAATATAGTTTTTCCAAAAC<br>TCAATTTATACTATTGTTATCGTTAAAAATAACGATAATTATTTGACTTCCATATGGTGTCCATTAAATAATTATTGT<br>CCATTTTAAAGAATTATTGTCCATTTTCAATTTATAGCGCTTATAGCTGAAACCTATTCATAGCAAGGGGTTCAGCTA<br>TTTTGTTTTTAGATTATTCTTTTCCTATTTTTAAATCAAATGATGTCATAAATCATATAAAATTTTAAAGTAAATGAT<br>GACATATTTTTTGGAGATGAGCTGATGCCCAGGAAGCCTACGAGCGAAGCCTTTCCAGGATTAGAGATTGAGGAAGC<br>GGCAAATCAGGAAGAAGAGCAAACAAAGCACCTACT |
| | RE<br>(SEQ ID<br>NO: 1053) | GTTTCAATAACCCTCACGGCTGGTGGTGGGTTGAAAGATTTTATCGCTATGTTTTCAGCAATTTCACTATTATGTCTT<br>CTATTGTAAAATTATTTATTAGGGTGGTTTGAAAGGAGCACTTCAATGGCATATTGCCAAAACCTGTGCAGTTGATC<br>CCATAGATCTCTAGATACATTTAGAGTCAATGTATCTTGCGAGAAACTTAACTTAATTTTGGACAATAATTATTTAA<br>AACTGGTTTCAACTCTGGACAATAATTATTTAAAACTGGTTTGAGTGCTGAAAGTCAAGAAAATAGGTTACTTATGT<br>CCCTTAACTACGTCAAAATGGACAAGAATTCTTTAAAACTGACAATAATAATTTAATGTACATATGGAGTTAAGCGG<br>ATTCGAACCGCTGGCCCCCTTCAATGCCATTGAAGTGCTCTACCAACTGAGCTATAACCCCGGAATACGCGTTTCTAA<br>TTATCGCTGAATAATATTATCTTTGTCAAGATTGGTA |
| AP018280/<br>Calothrix<br>sp.<br>NIES-4101/<br>T43 | TnsB<br>(SEQ ID<br>NO: 1054) | ATGACCCGTGTACCGGATCCTGCAGCCTCTGATCGACAAGGTGGAAAAGGCCAAGAGCATCAGAAGCCCCGGCTGGC<br>GAGGAAGCAGACTGAGCATCAAGACCAGAGATGGCAACGATCTGCAGGTCGAGCACGCAATCAAGTGTGGCAGT<br>GCGATCACACCCTGGTGGATGTGCTGCTGGTGGACAGACACGGCAAGCTGCTGTCTAGACCTTGGCTGACCATCGT<br>GATCGACAGCTACAGCAGATGCATCATGGGCATCAACCTGGGCTACGACGCCCCTAGCTCTAAGGTTGTGGCTCTG<br>GCCCTGAGACACGCCATCCTGCCTAAGCAGTACGGCAGCGACTACGGCCTGAATGAGGAATGGGGCACATCTGGCC<br>TGCCTCAGCACTTCTATACCGACGGCGGCAAGGACTTCAGATCCAACCATCTGCAGCAGATCGGCGTGCAGCTGGG<br>CTTCGTTAGACACCTGAGAGACAGACCTAGCGAAGGCGGCAGCGTGGAAAGACCCTTCAAGACCCTGAACACCGAG<br>CTGTTCAGCACCCTGCCTGGCTACACCGGCAGCAATATTCAGCAGAGCCTGAGGAAGCCGAGAACGAGGCTTGTC<br>TGACACTGCACCAGCTGGGAAAAGATCCTCGTGCGGTACATCGTGGACAACTACAACCAGCGGATCGACGCAGAAT<br>GGGCGACCAGACCAGATTTCAGAGATGGGAGAGCGGCCTGATCGCCGCTCCTGATCTGCTGTCTGAGAGAGAGCTG<br>GACATCTGCCTGATGAAGCAGACCAGACGGCACATCCAGAGAGGCGGCTACCTGCAGTTCGAGAACCTGATGTACC<br>GGGGCGAGAATCTGGCCGGATATGCCGGCGAAAAGGTGGTGCTGAGATACGACCCCAGAGACATCACCACCATCAT<br>GATCTACTGCACCGAGGGCGACAAAGAGGTGTTCCTGACCAGACCTACGCTCAGGACCTGGAAACCGAGGAACTG<br>AGCCTGGATGAGGCCAAGGCCAGCAGCAGAAAATGCGCGAAGCTGGACAGGCCGTGAACAACAGATCCATCCTG<br>GCCGAAGTGCGGGAAAGAGAAGTGTTCCCTACACAGAAAAAGACCAAGAAAGAGCGGCAGAAGCTGGAACAGAC<br>CGAGCTGAAGAAGTCCAAGCAGCCCATTCCTATCGAGCCAGAGGAACTGGACGAAGCCGTGTCCACCGAGGTGGA<br>AACAGAGCCTGAGATGCCCGAGGTGTTCGACTACGAGCAGATGAGAGAAGATTACGGCTGGTGA |
| | TnsC<br>(SEQ ID<br>NO: 1055) | ATGAGCAGCAAGGCCAGCACACAACAGAGGCCCAGGCTATTGCTCAGCAGCTGGGAGATATCCCCGCCAACAACGAG<br>AAGCTGCAGGCCGAGATCCAGCGGCTGAACAGAAAGGGCTTCGTGCCCCTGGAACAAGTGAAACCCTGCACGACT<br>GGCTGGAAGGCAAGCGGCAGTCTAGACAGTCTGGCAGAGTTGTGGGCGAGAGCAGAACCGGCAAGACCATGGGCT<br>GTGACGCCTACCGGCTGAGAAACAAGCCCAAGCAAGAGCGGCAAGCCTCCTACAGTGCCCGTGGCCTACATCCA<br>GATTCCTCAAGAGTGCGGCGCCAAAGAACTGTTCGGCGTGATCATGGAACACCTGAAGTACCAAGTGACCAAGGGC<br>ACCGTGGCCATTAGAGACAGAACCCCTGCCGGTGCGGGATGTGCGGAGTGGAAATGCTGATCATCGACGAG<br>GCCGACCGGTTCAAGCCTAAGACCTTTGCCGAAGTGCGGGACATCTTCGACAAGCTGGAAATCGCCGTGATCCTCGT<br>GGGCACCGATAGACTGGATGCCGTGATCAAGCGGGACGAACAGGTGTACAACCGGTTCAGAAGCTGCCACAGATTC<br>GGCAAGATGTCCGGCGAGGACTTCAAGCGGACCGTGGAAATCTGGAGAAGCAGATCCTGAAGCTGCCTGTGGCCA<br>GCAACCTGGGCAGCAAGACAATGCTGAAAACACTGGGCGAAGCCACCGGCGGCTATATCGGACTGCTGGACATGAT<br>CCTGAGAGAGAGCGCCATCAGAGCCCTGAAGAAGGGCCTGCAGAAGATCGACCTGGACACCCTGAAAGAAGTGAC<br>CGCCGAGTACCGGTGA |

TABLE 27-continued

| Name/<br>Organism/<br>System<br>ID (T) | | Sequences |
|---|---|---|
| | TniQ<br>(SEQ ID<br>NO: 1056) | ATGATGGAAGCCGAGGAAATCAAACCCTGGCTGTTCCAAGTGGAACCCTGGAAGGCGAGAGCATCAGCCACTTTC<br>TGGGCAGATTCCGGCTGGCCAACGATCTGACACCTTCTGGACTGGGACAAGCCGCTGGACTCGGCGGAGCTATTGC<br>CAGATGGGAGAAGTTCCGGTTCAACCCTCCACCTAGCCGGCAGCAGCTGGAATTCTCTGGCTGTGGTCGTGGGCGTC<br>GACACCGACAGACTGGAAAAGATGCTTCCTCCTGCCGGCGTGGGCATGAAGATGGAACCTATCGACTGTGCGCG<br>CCTGCTACGGCGAAAGCCCTTGTCACAAGATCGAGTGGCAGTTCAAAGAAACCGGCGGCTGCGGCAGACACAATCT<br>GACACTGCTGAGCGAGTGCCCCAATTGCGGCGCCAGATTCAAAGTGCCTGCTCTGTGGGTGGACGGCTGGTGCCAC<br>AGATGCTTTACCCCTTTCGCCGAGATGGTGGAACACCAGAAGCGGATCTGA |
| | Cas12k<br>(SEQ ID<br>NO: 1057) | ATGAGCCAGATCACCATCATGTGCCGGCTGGTGGCCAACGAGAGCACAAGACAGCAACTGTGGCAGCTGATGGCCG<br>AGCTGAACACCCCTCTGATCAACGAGCTGCTGGTGCTGATCTCCCAGCACCAGGACTTCGAGACATGGCAGCAGAA<br>GGGCAAGATCCCTGCCGGCACAGTGAAGCAGCTGTGCGAGAGCCTGAAAACAGACCCTGGCTTTGCCGGACAGCCC<br>GCCAGATTCTATGCCTCTGCTATCGCCACCGTGTCCTACGTGTACAAGGCCTGGATGAAGGTGCAGAAGCGGCTGAA<br>GTCCCAGCTGGAAGACAAGGCCAGATGGCTGAGCATGCTGCAGACGGACGAGGAACTGATTGCCATTGCTGGCGTG<br>GACCTGGACGGCCTGAGAAATCAGGCCAGACTGATCCTGCAGCAGTTCGCCCCTGAGCCTTCTCCACAAGAAGATC<br>TGCAGGCCAACAAGAAGCAGCCCAAGACCGAGAAGTCCCTGAGCCAGACACTGCTGGACACCTACGAGAGCAGCG<br>AGGACATCCTGACCAGATGCGCCATCTCCTACCTGCTGAAGAACGGCTGCAAGGTGTACGAGAAGCCCGAGAACAG<br>CCAGAAGTTCAGCAAGCACAAGGACAAGCTGAAAGTGCAGATCCAGATCCAGCGGCTGATCCAGAAACTGGAAGGCAGAGT<br>GCCCCAGGGCAGAAACCTGACCGATACCGAGTGGCTGGAAACCCTGATCCTGGCCACCGAGAGATTCCCCAGGAT<br>GAGGCCGAGGCCAAGAGCTGGCAAGACAGCCTGCTGAAAAAGTCCAGCAGCGTGATCTTCCCCGTGTCTTACGAGT<br>CCAACGAGGACATGACCTGGTTCAGAAACCAGAAAGGCCGGATCTGCATCAAGTTCAACGGCATCAGCGAGCACAC<br>CTTCGAGATCTACTGCGACAGCCGGCAGCTGCATTGATTTCTGAGCGACCAAGAGACAAAGAAGAAC<br>AGCAAGAACCAGCACAGCAGCGCCCTGTTCACACTGAGATCGCCAGAATCGGCTGGCACGAGCAAGAGATCAAG<br>AACAAGCAGATCTGTCGGCGGAAGCCCACCGTGAATCCCTGGGACATCTACCCACCTGACACTGTACTGCACCGTGG<br>ACACCAGACTGTGGACAGCCGAAGGCACAGCTGTTGTGGCCGCCGAGAAAGCCGAGGAAATCGCCAAGATCATCA<br>CCAAGACCAAAGAGAAGGACCTGAACGAGAAACAGCTGGCCCACATCAAGCGGAAGAATAGCACCCTGGAAC<br>GGATCAACAACCCCTATCCTCGGCCTAGCAAGCCCCTGTACCAGGCCAATCCTCACATCCTCGTGGGAGTGTCTCTG<br>GGCCTGAAGAAGCCTGCCACAATCGCCGTGGTGGACGTGATCTCTCAGAAGGTGCTGACCTACTGCAGCATCAAAC<br>AGCTGCTGGGCAAGAACTACAAGCTGCTGAACCGGCACAGACAGCTGAAGCACAACTTCGCCCACAAGAGAAAGA<br>TCGCCCAGACACAGGCCAAGCAGCAGCAGTACCTGGATTCTGAGCTGGGCCAGTACATCGACAGACTGCTGGCCAA<br>ACAGATTATCGCCATTGCCAAGCAGTACAGCGCCAGCTCCATTGTGCCCCCAGCTGAATGCATGAGAGAGCAG<br>ATCAACAGCGAGATCCAGGCCAAGGCCAAAGAAAAGTGCCCCGAGTCTATCGAGGCCCAGAAGAAGTACGCCAAA<br>CAGTACCGGCGGAGCATCAACCAGTGGTCCTATGGCAGGCTGATCGAGAGCATCATCAGCCAGGGACTGCAGGCCG<br>GAATCGCCATCGAGGAATCTAAACAGGCCGTGCAGGGCAGCCCTCAAGAGAAGGCTAAAGAACTGGCCTTCGTGGC<br>CTACAACAGCCGGAAGAAGTCCTGA |
| | TracrRNA<br>(SEQ ID<br>NO: 1058) | CGCACAAATTGCGTCCGAACCATGAAAATAGAATAAATAATTAACAGCGCCGTTGTTCATGCGTTTTTTGCGTCTCT<br>GAGCAATGATAAATTTGGGTTAGTTTGACTGTTGGAAATACAGTCTTGCTTTCTGACCCTGGTAGCTGCCCACCTTG<br>AAGCTGCTATCTCTTGTAGATAGGACATAAGGTGCGCCCCAGTAATAGAGGTGCGGGTTTACCGCAGTGGTGAGT<br>CCACTTACCGGGAAGATGTTATTTTCGGTAAAGTGGCGAATCCGAAGGGTGGCTACTGAATCACCTCCGAGCAAGG<br>AGGAACCCACCTTAATTATTTTTGGCATGGCAAAGCGGGGCGATTCCCTGGGACTCCTGCCAAATCTTCAAATCC<br>CTTTATTGGTATTCTTTCTAGAGTTTGGACTGTCACTTGATTTACTTTTTCAGTGTCAACCAGCAGGTGGTTTTGG<br>TAGTCCTGTCAAAAGTACTTCTAGGAGGCTTAATAAATAAAGGGTTTCAGGCGCGGA |
| | DR<br>(SEQ ID<br>NO: 1059) | GTTTCAATGCCCCTCCTAGCTTGAGGCGGGTTGAAAG |
| | sgRNA<br>(SEQ ID<br>NO: 1060) | CGCACAAATTGCGTCCGAACCATGAAAATAGAATAAATAATTAACAGCGCCGTTGTTCATGCGTTTTTTGCGTCTCT<br>GAGCAATGATAAATTTGGGTTAGTTTGACTGTTGGAAATACAGTCTTGCTTTCTGACCCTGGTAGCTGCCCACCTTG<br>AAGCTGCTATCTCTTGTAGATAGGACATAAGGTGCGCCCCAGTAATAGAGGTGCGGGTTTACCGCAGTGGTGAGT<br>CCACTTACCGGGAAGATGTTATTTTCGGTAAAGTGGCGAATCCGAAGGGTGGCTACTGAATCACCTCCGAGCAAGGA<br>GGAACCCACCTTAATTATTTTTGGCATGGCAAAGCGGGGCGATTCCCTGGGACTCCTGCCAAATCTTCAAATCCC<br>TTTATTGGTATTCTTTCTAGAGTTTGGACTGTCACTTGATTTACTTTTTCAGTGTCAACCAGCAGGTGGTTTTGGT<br>AGTCCTGTCAAAAGTACTTCTAGGAGGCTTAATAAATAAAGGGTTTCAGGCGCGGAGAAATCCTAGCTTGAGGCGGG<br>TTGAAAGNNNNNNNNNNNNNNNNNNNNNNNN |
| | LE<br>(SEQ ID<br>NO: 1061) | GATTCGACCTGATTTGGAGTAAAATGAAACAAATTGAAGTTTGACTCGTTGAGGCTGGGTGCTGCTTCTGGAGCCGA<br>AAACGAGGGAATATTAATGTACATTAACTAATTATTTGTCAATTTAACAAAATAATTGTCATATTATTCAAAATCAC<br>TCAATCCCTGTCATTGCAATAACTATGACAGGGATTTTGTTATTACAACCAGTCACAGCGCTTTCAGCTTTGATTCAC<br>AAATTAGATGTCAAAATCCAGAATTTTCACAATTTAATTGTCACTTCTCAAAAATAGTAGACAATCATGATTTTGCA<br>TAAATTAACACATTAATTGTCACATTATTAGTATAATACAACTATGTTTTGATAAAGCACTGTATGCAGGATGCAGA<br>ATTTTCTACAACTTCTACGACAAAGGTAAGTTGCACAGATGTTAATAGCACTGAAGCAAACATTATTGTTTCCGAAC<br>TTTCGGATGAAGCTTTGTTGAAAATGGAGGTAATTCA |
| | RE<br>(SEQ ID<br>NO: 1062) | GTTTCAATGCCCCTCCTAGCTTGAGGCGGAAAGACCTCTTGGCGATGCGATTGCCTTTAATTTGGCAGTTTCAAGTA<br>AATAGTTGGTTAAAATATTTAAGGTGGGTTGAAAGGTAAGGCAGAGGTCTGCCATTAAAAAATGCCACATGCATGA<br>GGCAGTGACATTTATTTTGTTAACATTGACATCAATCTGTTAGAAATGACATTAATTTGTTAACAGTGACAAATAAT<br>TAGTTAATGTACAACAAACAAAGGCGACACCCGGATTTGAACCGGGGATGGAGGTTTTGCAGACCTCTGCCTTAC<br>CACTTGGCTATGTCGCCACAACTAACAATTACATATATTAGCACCATTTCGAATATTATTCCACTTTTTCAGCAACA<br>GGTTAATTTTACCACCAGTAATACGACTATCAGGGCATAAACCAAGCCATGAGGTAAATGCTTGACTGTAGCAAT<br>GCCTTCGCCAGATTTCTGAGTGATGACGTAGTATCAAAGC |
| CP000117/<br>Trichormus<br>variabilis<br>ATCC 29413/<br>T44 | TnsB<br>(SEQ ID<br>NO: 1063) | ATGTACCAGCAGCTGCAGGATAGCTACCCCGCCAATGATGATGGCGCCGTGGAACTGCAGAAGCACCAGAACAGCA<br>CCAAGACCAGCAGCAAGCTGCCCAGCGAGAAGCTGATCACCGACGACGTGAAGCTGCGGATGGAAGTGATCCAGA<br>GCCTGACCGAGCCTTGCGACAGAAAGACCTACTCCGAGAAGAAGAAAGAGGCCGCCGAGAAACTGGGCGTGACCA<br>TCAGACAGGTGGAACGGCTGCTGAAGAAGTGGCGCGAGAAGGACTTGTCGGCCTGGCCACAAGACGAAGGAATCA<br>AGGGCAAGTACCGGCTGGAACAAGAGTGGGTCGACTTCATCATCAACACCTACACCAACGGCAACAAGAAAGGCA<br>AGCAGATGACCCGGCACCAGGTGTTCCTCAAAGTGAAGGGCGAAGCCAAAGAAGGGCCTGAGAAAGGCGAGT<br>ACCCCAGCCACCAGAGCATCTACAGAATCCTGGACAAGCACATCGAGGGCAAAGAGCGGAAGGACAACGCCAGAT<br>CTCCTGGCTACAGCGGCGAAAAGCTGACCCACATGACCCGCGACGGCAGAACTGGAAGTGGAAGGCAGCAACG<br>ACGTGTGGCAGTGCGATCACACCAGACTGGACGTGATGCTGGTGGACGAGTACGGCGTGCTGGATAGACCTTGGCT |

TABLE 27-continued

| Name/<br>Organism/<br>System<br>ID (T) | Sequences |
|---|---|
| | GACCATCGTGATCGACAGCTACAGCAGATGCGTGATGGGCTTCTACCTGGGCTTCGATCACCCCAGCAGCCAGATTG<br>ATGCCCTGGCTCTGCACCACGCCATCCTGCCTAAGAGCTACAGCTCCGAGTACACCCTGAGACACGAGTGGGTTGCC<br>TACGGCAAGCCCAACTACTTCTACACCGACGGCGGCAAGGACTTCACCTCCATCCACACCACAGAACAGGTGGCCG<br>TGCAGATCGGCTTTAGCTGTGCCCTGAGAAGAAGGCCTAGCGACGGCGGAATCGTGGAACGGTTCTTCAAGACCCT<br>GAACGAACAGGTGCTGAACACCCTGCCAGGCTACACCGGCTCTAATGTGCAGCAGAGGCCCGAGAACGTGGACAA<br>GAATGCCTGTCTGACCCTGAAAAACCTGGAAATGGTGCTCGTGCGGTACATCGTGGATGAGTACAACCAGCACACC<br>GACGCCAGAATGAAGGACCAGAGCAGAATCGGCAGATGGGAGGCCGGCTCTATGGTGGAACCCTACCTGTACAAC<br>GAGCTGGACCTGGCCATCTGCCTGATGAAGCAAGAGCGGCGGAAGGTGCAGAAGTACGGCTGCATCCAGTTCGAGA<br>ACCTGACCTACAGAGCCGACCACCTGAGAGGCAGAGATGGGGAAACAGTGGCCCTGAGATACGACCCCGCCGATG<br>TGACAACACTGCTGGTGTATGAGATCAACGCCGACGGCACCGAGGAATTTCTGGACTATGCCCACGCTCAGAGCCT<br>GGAAACAGAGCACCTGAGCCTGAGAGAGCTGAAGGCCATCAACAAGCGGCTGAAAGAAGCCAGCGAGGAAATCAA<br>CAACGACAGCATCCTGGAAGCCATGCTGGACAGACAGGCCTTCGTGGAACAGACCGTGAAGCAGAACCGGAAGCA<br>GAGAAGGCAGGCCGCCAGCGAGCAAGTGAATCCTGTGGAACCCGTGGCCAAGAAATTCGCCGTGCCTGAGCCTAA<br>AGAGGTGGAAACCGACAGCGAGCCCGACATGGAACTGCCCAATTACGAAGTGCGCTACATGGACGAGTTCTTCGAG<br>GAAGATTGA |
| TnsC<br>(SEQ ID<br>NO: 1064) | ATGACCGATGCCAAGCCTCTGGACTTCATCCAAGAGCCTACCAGAGAGATTCAGGCCCACATCGAGAGACTGAGCA<br>GAGCCCCTTACCTGGAACTGAATCAAGTGAAGTCCTGCCACACCTGGATGTACGAGCTGGTCATCAGCAGAATGAC<br>CGGCCTGCTCGTGGGCGAGTCTAGATCTGGCAAGACCGTGACCTGCAAGGCCTTCCGGAACAACTACAACAACCTG<br>CGGCAGGGCCAAGAGCAGAGAATCAAGCCCGTGGTGTATATCCAGATCAGCAAGAACTGCGGCAGCCGCGAGCTG<br>TTCGTGAAGATTCTGAAGGCCCTGAACAAGCCCAGCAACGGCACAATCGCCGACCTGAGAGAGAGAACCCTGGACA<br>GCCTGGAAATCCACCAGGTGGAAATGCTGATCATCGACGAGGCCAACCACCTGAAGATCGAGACATTCAGCGACGT<br>GCGGCACATCTACGACGAGGACTCCCTGAAGATTAGCGTGCTGCTTGTGGGCACCACCTCCAGACTGCTGGCCGTG<br>GTTAAGAGGGATGAGCAGGTCGTGAACCGCTTCCTGGAAAAGTTCGAGATCGACAAGCTGGAAGAGAACCAGTTCA<br>AGCAGATGATCCAAGTGTGGAGCGCGACGTGCTGAGACTGCCCTGAGGAATCTAAACTGGCCAGCGGCGAGAGCTT<br>CAAGCTGCTGAAGCAGAGCACCAACAAGCTGATCGGCCGGCTGGACATGATCCTGAGAAAGGCCGCCATCAGAAG<br>CCTGCTGCGGGGCTACAAGAAAGTGGATCAGGGCGTGCTGAAAGAGATCATCACCGCCACCAAGTTCTGA |
| TniQ<br>(SEQ ID<br>NO: 1065) | ATGCGCGAGAGCATCAACGAGAACAAGCAGTTCTGGCTGATCAGAGTGGAACCCCTGGAAGGCGAGTCCATCAGCC<br>ACTTTCTGGGCAGATTCAGAAGAGAGAAGGGCAACAAGTTCAGCGCCCCTAGCGGACTGGGAGGATGTTGCTGGACT<br>TGGGACCGTGCTGGCCAGATGGGAGAAGTTCTACTTCAACCCATTTCCGACGCACCAAGAGCTGGAAGCCCTGGCT<br>TCTGTGGTGCAAGTGGATGTGGACCGGCTGAGACAGATGTTGCCTCCTCTGGGCGTGTCCATGAAGCACAGCCCTAT<br>CAGACTGTGCGGCGCCTGTTATGCCGAGTCTCCCTGTCACAAGATCGAGTGGCAGTTCAAGAAAACCGTGGGCTGC<br>GACCGGCACCAGCTGAGACTGCTGTCTAAGTGTCCCGTGTGCGAGAAGCCCTTTCCTGGTGCCTGCTCTGTGGGTGGA<br>CGGCATCTGCAACAGATGCTTCACCCCTTTCGCCAGCGAGATGCCCAGTACCAGAAGCACTACTGA |
| Cas12k<br>(SEQ ID<br>NO: 1066) | ATGAGCGTGATCACCATCCAGTGCAGACTGATCGCCAGCGAGGCCACCAGATCTTACCTGTGGCAGCTGATGGCCC<br>AGAAGAACACCCCTCTGATCAACGAGCTGATCGAGCAGCTGGGCATTCACCCCGAGATTGAGCAGTGGCTGAAGAA<br>GGGCAAACTGCCCGACGGCGTTGTGAAGCCTCTGTGCGATAGCCTGATCACCCAAGAGAGCTTCGCCAACCAGCCT<br>AAGCGGTTCAACAAGAGCGCCATCGAGGTGGTCGAGTACATCTACAAGAGCTGGCTGGCCCTGCAGAAAGACGG<br>CAGCAGACCATCGACCGGAAAGAACACTGGCTGAAAATGCTGAAGTCCGACGTGGAACTGGAACAAGAGTCCAAG<br>TGCACCCTGGACGCCATCAGAAGCCAGGCCACAAAGATCCTGCCTAAGTATCTGGCCCAGAGCGAGCAGAACAACA<br>ATCAGACCCAGAGCCAGAACAAGAAGAAGTCCAAGAAGTCTAAGACCAAGAACGAGAACAGCACCCTGTTCGACA<br>TCCTGTTCAAGGCCTACGACAAGGCCAAGAATCCCCTGAACAGATGTACCCTGGCCTACCTGCTGAAGAACAACTG<br>CCAGGTGTCCCAGAAGGACGAGGACCCCAATCAGTACGCCCTGCGGAGATCCAAGAAAGAGAAAGAGATCGAGCG<br>CCTGAAGAAGCAGCTGCAGAGCAGAAAGCCCAACGGCAGAGATCTGACCGGCAGAGAGTGGCAGCAAACCCTGAT<br>CATGGGCCACCTCTAGCGTGCCCGAGAGCAACGACGAGGCCAACATCTGGCAGAAGCGGCTGCTGAAAAAGGACAT<br>CAGCCTGCCTTTTCCAATCCGGTTCCGGACCAACGAGGACCTGATCTGGTCCAAGAATGAAGAGGGCAGAATCTGC<br>GTGTCCTTCAGCGGCGAGGGCCTGAACGATCACATCTTCGAGATCTACTGCGGCAACCGGCAGATCCACTGGTTCCA<br>GCGGTTTCTGGAAGATCAGAACATCAAGAATGACAACAACGACCAGCACAGCAGCGCCCTGTTCACACTGAGATCT<br>GCCATCCTGGCCTGGCAAGAGAACAAGCAGCACAAAGAGAACTCCCTGCCTTGGAACACCAGACGGCTGACCCTGT<br>ACTGCACACTGGACACCAGACTGTGGACCACCGACGGCACCAGAAAGTGAAGCAAGAGAAGGTGGACGAGTTCA<br>CCCAGCAGCTGGCCAACATGGAACAGAAAGAAAACCTGAACCAGAACCAGCAGAACTACGTGAAGAGGCTGCAGT<br>CTACCCTGAACAAGCTGAACAACGCCTATCCTCGGCACAACCACGACCTGTACCAGGGCAAGCCTTCTATCCTCGTG<br>GGAGTGTCTCTGGGCCTCGAGAAACCTGCCACACTGGCCATCGTGGACAGCAGCACCAATATCGTGCTGGCCTACA<br>GATCCATCAAGCAACTGCTGGGCGACAACTACAAGCTGCTGAACAGACGCCGCCAGCAGCGCAGAGAAACAGCC<br>ACGAGAGACACAAGGCCCAGAAAAGCAACATGCCCAACAAGCTGTCCGAGAGCGACCTGGGCAAGTACATCGACA<br>ATCTGCTGGCCCAGGCCATCATTGCCCTGGCCAAAAATTACCAGGCCGGCTCCATCGTGCTGCCCACCATGAAGAAT<br>GTGCGCGAGAGCATCCAGTCCGAGATCGAAGCCAGAGCCGTGAAGAGATGCCCCAACTACAAAGAGGGCCAGCAA<br>CAGTACGCCAAGCAGTACAGACAGAGCATTCACCGGTGGTCCTACAACCGGCTGATGCAGTTCATCCAGTCTCAGG<br>CCGTGAAGGCCAATATCAGCATCGAGCAGGGCCCTCAGCCTATCAGAGGCAGCTCTCAAGAGAAAGCTCGCGACCT<br>GGCCATTGCCGCCTACTACCTGAGACAGAACAAGTCCTGA |
| TracrRNA<br>(SEQ ID<br>NO: 1067) | TTTTTGATTAAGCAAATATACTGAACCTTGACAATAAAATAAGTAATAGCGCCGCAGTTCATGTTAAACCTCTGAAC<br>TGTGAAAAATCTGGGTTAGGTTGACTATTGGAAAATAGTCCTGCTTTCTGACCCTGGTAGCTGCTCACCCCGATGCT<br>GCTGTTTCCGAACAGGAATTAGGTGCGCTCCCAGCAATAAGGGCGCGGATATACTGCTGTAGTGGCTACCGAATCA<br>CCTCCGATCAAGGAGGAACCCATACCAATCCTTGTTTCCAGGCATTAGAAGAGATTAAAAATTTTCAGTCGATTCGC<br>GCTTGCTTGCTGTGAAAGGATTTTAGCGTTTAATGGCACAAAAATTGCTCATTCAAACGGCAGTTGAAGAAGCTAGG<br>AATATAGATCCGCGCTATCAACTCTGGAATCCTCCACAAAACAAGGATTCTATACAGGAAGG |
| DR<br>(SEQ ID<br>NO: 1068) | GTGACAATAGCCCTTCCCGTGTTGAGCGGGTTGAAAG |
| sgRNA<br>(SEQ ID<br>NO: 1069) | TTTTTGATTAAGCAAATATACTGAACCTTGACAATAAAATAAGTAATAGCGCCGCAGTTCATGTTAAACCTCTGAAC<br>TGTGAAAAATCTGGGTTAGGTTGACTATTGGAAAATAGTCCTGCTTTCTGACCCTGGTAGCTGCTCACCCCGATGCT<br>GCTGTTTCCGAACAGGAATTAGGTGCGCTCCCAGCAATAAGGGCGCGGATATACTGCTGTAGTGGCTACCGAATCA<br>CCTCCGATCAAGGAGGAACCCATACCAATCCTTGTTTCCAGGCATTAGAAGAGATTAAAAATTTTCAGTCGATTCGC<br>GCTTGCTTGCTGTGAAAGGATTTTAGCGTTTAATGGCACAAAAATTGCTCATTCAAACGGCAGTTGAAGAAGCTAGG<br>AATATAGATCCGCGCTATCAACTCTGGAATCCTCCACAAAACAAGGATTCTATACAGGAAGGGAAATTCCCGTGTT<br>GAGCGGGTTGAAAGNNNNNNNNNNNNNNNNNNNNNNN |

TABLE 27-continued

| Name/<br>Organism/<br>System<br>ID (T) | | Sequences |
|---|---|---|
| | LE<br>(SEQ ID<br>NO: 1070) | ATGTCTACTTGTGGTAAAAATAGTGTTTTTGCTTGCCACTAACACAGAAAAATAAAGGAAGCAATATGTATAAATTA<br>TTACAAGCTGTACATTCACATATTAGATGTCGCTATTTAACAAATTAATGTCGCAAGCTTTAAAGCATAAAACCCTT<br>TCCCCGTAAGGATTTTATAGATTTATATGATTGTATAAAAGTGACTAGAGATTTTTCATGGTTTTCACAAATTGAGGT<br>CGCAAACCCGATAATTTCACAATTTAAGAGTCGTTTATTTTCTTCAGCCAGACAACCTAACGTTAAACGGCTTCACG<br>AATTAGATGTCGCATTCCTGAGAGTGGCAATATATTTACTTACTCTAAAAGATAAAACCTGATTAATGGCAGTATGG<br>CTGCATCAGTGCTGGAAAATTAACTGTCTTATCCTATTTCAGTGTATAACTAAAAAAATTAGCTACTAATCTTACATA<br>ACGAGGTTTCAGTTGTGGCGTTTCAACCTGAAGACA |
| | RE<br>(SEQ ID<br>NO: 1071) | TAATTATGTATGTATTCATCTCCATTAGGATGGGTGAGAGTGATAATAACCATTCACGAAAGAATGGATTGAAAATG<br>TAATACCTAACGATAAACAGAAATAGGCAAGTTATATAAATCTTTCCGGTGCAGGACTGGTTGAAATATAAAGATT<br>ACAAGATGTGGGTATGGGTTGAAAGGGTTCAAATCCGTCTGCTTAACTTTTGCTGCCAAGCATAGTGGTTAGAATAA<br>TTGTGTGCGAAATAAAGAACAAAAGTTTTTTGTTTAACCAAGGTATAGCAAAAGTTTTTAGAGCTTGAGCTAAAATT<br>GAGCTTATGGTCTTCTATTTGATAGGACTGATGTTGACCAATCACCCCCACACAATCGATTAGTCTCAAATATTGCGA<br>CATTAATTTGTGAACGGTTATCTTAAATGAGCCGCGACACTAATTAGTGAAACAGCGACATTAATGTGTGAACGGCG<br>ACATCTAATGTGTGAATGTACAACAAGCTAAGAGCTTCTTTCGGTCGGAGGTTTAACCTAAAGCCAGCAGTCGGATT<br>TGAACCGACGACCTTCCGATTACAAGT |
| CP001037/<br>Nostoc<br>punctiforme<br>PCC 73102/<br>T45 | TnsB<br>(SEQ ID<br>NO: 1072) | ATGAACAGCCAGCAGAACCCCGATCTGGCCGTGCATCCTAGCGCCATTCCTATCGAAGGACTGCTGGGCGAGAGCG<br>ACATCACCCTGGAAAAGAACGTGATCGCCACACAGCTGAGCGAGGAAGCCCAGCTGAAGCTGGAAGTGATCCAGA<br>GCCTGCTGGAACCCTGCGACAGAACCACATACGGCCAGAAGCTGAGAGAGGCCGCCGAGAAACTGGGAGTGTCTCT<br>GAGACCGTGCAGCGGCTGGTCAAGAACTGGGAGCATGATGGACTCGTGGGCCTGACACAGACAGGCAGAGCCGA<br>TAAGGGCAAGCACAGAATCGGCGAGTTCTGGGAGAAGTTCATCACCAAGACCTACAACGAGGGCAACAAGGGCAG<br>CAAGCGGATGACCCCTAAACAGGTGGCCCTGAGAGTGGAAGCCAAGGCCAGAGAACTGAAGGACAGCAAGCCTCC<br>TAACTACAAGACCGTGCTGAGAGTGCTGGCCCCTATTCTGGAAAAGCAAGAGAAGGCCAAGAGCATCAGAAGCCCT<br>GGCTGGCGGGAACAACCCTGAGCGTGAAAACCAGAGAGGGCAAAGACCTGTCCGTGGACTACAGCAACCACGTG<br>TGGCAGTGCGGACCACACCAGAGTGGATGTGCTGCTGGTGGATCAGCACGGCGAGCTGCTTTCTAGACCTTGGCTGA<br>CCACCGTGATCGACACCTACAGCAGATGCATCATGGGCATCAACCTGGGCTTCGACGCCCCTTCTAGCGGAGTTGTT<br>GCTCTGGCTCTGCGCACACGCCATTCTGCCTAAGCAGTACGGCTTCGAGTACAAGCTGCACTGCGAGTGGGGCACCTA<br>TGGCCAGCCTGAGCACTTCTACACCGACGGCGACAAGGACTTCAGAAGCAACCACCTGTCTCAGATCGGCGCCAG<br>CTCGGCTTTGTGTGCCACCTGAGAGACAGACCTAGCGAAGGCGGCGTGGTGGAAAGACCCTTCAAGACCCTGAACG<br>ACCAGCTGTTCAGCACCCTGCCTGGCTACACAGGCAGCAACGTGCAAGAGAGGCCTAAGGACGCCGAGAAGGATG<br>CCAGACTGACCCTGAGAGAGCTGGAACAGCTGCTGATCCGGTACATCGTGGACCGGTACAACCAGAGCATCGACGC<br>CAGAATGGGCGATCAGACCAGATTCGAGAGATGGGAGGCCGGACTGCCTACAGTGCCTGTGCCTATTCCAGAGCGC<br>GACCTGGACATCTGCCTGATGAAGCAGAGCAGACGGACAGTGCAGAGAGGCCGGCTGTCTGCAGTTCCAGAACCTGA<br>TGTACAGAGGCGAGTACCTGGCCGGCTATGCCGGCGAGACAGTGAACCTGAGATTCGACCCAGACATCACCAC<br>CATCCTGGTGTACCGGCAAGAGAACAATCAAGAGGTGTTCCTGACCAGGGCTCACGCCCAGGGACTCGAAACAGAA<br>CAACTGGCCCTGGATGAAGCCGAAGCCGCTAGCAGAAGGCTGAGAAACGCCGGCAAGACCATCAGCAATCAGTCC<br>CTGCTGCAAGAGGTGGTGGACAGATGCCTGGTGGCCACTAAGAAGTCCCGGAAAGAGCGGCAGAACTGGAA<br>CAGGCTGTGCTGAGATCTGCCGGCGTGGACGAGAGCAAGACAGAGTCACTGTCTAGCCAGGTGGTCGAGCCCGATG<br>AGGTGGAAAGCACAGAGACAGTGCACAGCCAGTACGAGGACATGAAGTGTGGGACTACGAGCAGCTGCGGGAAG<br>AGTATGGCTTCTGA |
| | TnsC<br>(SEQ ID<br>NO: 1073) | ATGACAGAGGCCCAGGCCATTGCCAAACAGCTCGGCGGAGTGAAGCCCGACGATGAATGGCTGCAGGCCGAGATC<br>GCTAGACTGAAGGGCAAGAGCATCGTGCCCCTGCAGCAAGTGAAAACCCTGCACGATTGGCTGGACGGCAAGCGG<br>AAAGCCAGACAGAGCTGTAGAGTCGTGGGCGAGAGCAGAACCGGAAAGACCGTGGCCTGTGACGCCTACCGGTAC<br>AGACAGAAACCCCAGCAAGAAGTGGGCAGACCTCCTATCGTGCCCGTGGTGTATATCCAGCCTCCTCAGAAGTGCG<br>GCAGCAAGGACCTGTTCAAAGAGATGATCGAGTACCTGAAGTTCCGAGGCCACCAAGGGCACCGTGTCGATTTCAG<br>AGGCAGAGCCATGGAAGTGCTGAAAGGCTGCGGCGTGAAATGCTGATCATCGACGAGGCCGACCGGCTGAAGCC<br>TGAGACATTTGCTGAAGTGCGGGACATCTACGACAAGCTGGGAATCGCCGTGGTGCTCGTGGGCACCGATAGACTG<br>GAAGCCGTGATCAAGCGGGACGAACAGGTGTACAACCGGTTCAGAGCCTGCCACAGATTCGGCAAGCTGAGCGGC<br>AAGGACTTCCAGGATACAGTGCAGGCCTGGGAAGATCGGGTGCTGAAGCTGCCTGTGTCCAGCAACCTGACCTCCA<br>AGGACATGCTGCGGATCCTGACAAGCGCCACCGAGGGCTATATCGGCAGACTGGACGAGATCCTGAGAGAGACAG<br>CCATCCGCAGCCTGAGCAAGGGCTTCAAGAAAATCGACAAGGCCGTGCTGCAAGAGGTGGCCAAAGAGTACAAGT<br>AA |
| | TniQ<br>(SEQ ID<br>NO: 1074) | ATGACCACACCTGACGTGAAGCCCTGGCTGTTCATCATCGAGCCCTATCCTGGCGAGAGCCTGAGCCACTTCCTGGG<br>CAGATTCAGACGGGCCAACCATCTGTCTCCAGCCGGACTTGGAGGACTGGCCGGAATTGGAGCTGTGGTGGCCAGA<br>TGGGAGAGATTCCACTTCAACCCCAGACCTAGCCAGAAAGAGCTGGAAGCCATTGCCAGCGTGGTGGAAGTGGATG<br>CCCAGAGACTGGCTCAGATGCTTCCTCCTGCTGGCGTGGGAATGCAGCACGAGCCTATAGACTGTGCGGCGCCTGT<br>TATGCCGAGGCTCCTTGTCACAGAATCGAGTGGCAGTACAAGTCCGTGTGGAAGTGCGACCGGCACCAGCTGAAGA<br>TCCTGGCCAAGTGTCCCAACTGTCAGGCCCCTTTCAAGATGCCCGCTCTGTGGGAGGATGGCTGCTGCCACAGATGC<br>AGAACACTGTTCGCCGATGGCCAAGCAGCAGAAGTCCTGA |
| | Cas12k<br>(SEQ ID<br>NO: 1075) | ATGAGCCAGATCACCATCCAGTGCAGACTGATCGCCAGCGAGAGCACCAGACAGAAACTGTGGAAGCTGATGGCC<br>ACACTGAACACCCCTCTGATCAACGAGCTGATCGAGCAGCTGGGCAAGCACCCCGACTTGAGAATTGGAGACAGC<br>AGGGCAGCTGCCCACCACCGTTGTGTCTCAGCTGTGCAGCGCCTGAAAACAGACCCCAGATTCGTGGGCCAGCGCT<br>AGCAGACTGCATATGAGCGCCATCCACATCGTGGACTACATCTACAAGAGCTGGCTGGCCATCCAGAACGGCTGC<br>AGCAACAGCTGGACGGCAAGATGAGATGGCTGGAAATGCTGAACAGCGACGTGGAACTGGTGAAACCAGCGGCA<br>GCTCTATGGGCGCCATCAGAACAAAGGCCTCCGAGATCCTGGCCAAGGCCATGCCTACAAGCGACAGCGATAGCAG<br>CCAGCCTAAGACCAAGAGGGCAAGAGGCCAAGAAGCTCAGCAGCTCCAGCGATAGATCCCTGAGCAACAA<br>GCTGTTCGAGGCCTACAAGAGACAGAGGACATCCTGAGCGAAGCCGCCATCTCCTACCTGCTGAAGAACGGCTGC<br>AAGCTGAGCGACAAAGAAGAGGACAGCGAGAAGTTCGCCAAGCGGCGAGACAGGTGGAAATCCAGATCCAGAG<br>ACTGACCGAGAAGCTGATCTCCAGAATGCCCAAGGGCCGCGACCTGACCAACAGAAAGTGGCTCGAGACACTGTTC<br>ACCGCCACCACCACCTTTCACAGAGGATAACGCCGAGGCCAAGCGGTGGTGCAGATTATCTGCTGCAGCAGCTAGCA<br>GCCTGCCTTTTCCACTGGTGTTCGAGACAAACGAGGACATGGTCTGGTCCAAGAACCAGAAAGGCCGGCTGTGCGT<br>GCACTTCAACGGCCTGAGCGATCTGAGCTTCGAGGTGTACTGCGACAACCGGCAGCTGCACTGGTTCAGCGGTTTC<br>TCGAGGACCAGCAGACCAAGAGGCAGTCCAAGAGCCAGTACGCAGCGGCCTGTTCACCCTGAGAAATGGCCACCT<br>CGTGTGGCAAGAAGGCGAGGGCAAAAGCGAGCCCTGGAACCTGAACCGGCTGAACCTGTACTGCTGCGTGGACAA<br>CAGACTGTGGACCGCCGATGGCACAGAGCAAGTGCGGCAAGAGAAGGCCGAGGAAATCAGCAAGCTGATCACCAA |

TABLE 27-continued

| Name/<br>Organism/<br>System<br>ID (T) | | Sequences |
|---|---|---|
| | | GATGAAGGAAAAGAGCGACCTGAAGGACACCCAGAAGGCCTTTATCCAGCGGAAAGAGTCTACCCTGAACCGCAT<br>GAACAACAGCTTCGAGAGGCCCAGCCAGCCACTGTATCAGGGCCAGTCTCATATCCTCGTGGGCGTGTCACTGGGA<br>CTCGAGAAGCCTGCTACAGTCGCCGTGGTGGATGCCAGTGTTGCCGGAAGGTTCTGGCCTACCGGTCCATCAGACAGCT<br>GCTGGGCGACAACTACGAGCTGCTGAATAGACAGCGGCGGCAGCAGAGAAGCAGCAGCCACGAAAGACACAAGGC<br>CCAGAAGTCTTTCAGCCCCAACCAGTTCGGCACAAGCGAGCTGGGCCAGTACGTTGACAGACTGCTGGCCAAAGAG<br>ATCATTGCTATCGCCCAGACCTACAAGGCCGGCAACATCGTGCTGCCTAAGCTGGGAGACATGCGCGAGATCGTGC<br>AGAGCGAGATTCAGGCTATCGCCGAGGCTAAGTGTCCCGGCTCTGTGGAAGTGCAGCAGAAGTATGCCAAGCAGTA<br>TCGCGTGAACGTGCACAAGTGGTCCTACGGCAGGCTGATCCAGAGCATCCAGTCTAAGGGAAGCCAGGCCGGCATC<br>GTGATCGAAGAGGGAAAGCAGCCTGTGCGGGATCTCCTCACGAGCAGGCTAAAGAACTGGCTCTGAGCGCCTACC<br>ACGACCGGCTGGCTAGAAGATCTTGA |
| | TracrRNA<br>(SEQ ID<br>NO: 1076) | CAAATATCTGAACCTTGACAATAGAATATTAATAGCGCCGCAATTCATGCTGCTTGCAGCCTCTGAACTGTGTTAAA<br>TGAGGGTTAGTTTGACTGTAGCAATATAGTCTTGCTTTCTGACCCTAGTAGCTGCTCACCCTGATGCTGCTGTCTTTA<br>TGACAGGATAGGTGCGCTCCCAGCAATAAGGGCGCGGATGTACTGCTGTAGTGGCTACTGAATCACCCCCGATCAA<br>GGGGGAACCCTCCCCAATTCTTCATTTGAAGGACTAAAATCAAGGCAAAATTTCTAAGAGTTTCGCGCAAGTTCCAA<br>ATACCTTGCCCCGTCTGAATTTATCGTTTTTCCATACAGATATGATTCTTGTGACTGAGGCTCAAATAGGAAATTGGG<br>AAACATACGCGCTGAGGAAATCTAGAAAAGTTGCCCTACAATATTTTGAAACTGAGTGG |
| | DR<br>(SEQ ID<br>NO: 1077) | GTGGCAACAACCCTCCAGGTACTGGGTGGGTTGAAAG |
| | sgRNA<br>(SEQ ID<br>NO: 1078) | CAAATATCTGAACCTTGACAATAGAATATTAATAGCGCCGCAATTCATGCTGCTTGCAGCCTCTGAACTGTGTTAAA<br>TGAGGGTTAGTTTGACTGTAGCAATATAGTCTTGCTTTCTGACCCTAGTAGCTGCTCACCCTGATGCTGCTGTCTTTA<br>TGACAGGATAGGTGCGCTCCCAGCAATAAGGGCGCGGATGTACTGCTGTAGTGGCTACTGAATCACCCCCGATCAA<br>GGGGGAACCCTCCCCAATTCTTCATTTGAAGGACTAAAATCAAGGCAAAATTTCTAAGAGTTTCGCGCAAGTTCCAA<br>ATACCTTGCCCCGTCTGAATTTATCGTTTTTCCATACAGATATGATTCTTGTGACTGAGGCTCAAATAGGAAATTGGG<br>AAACATACGCGCTGAGGAAATCTAGAAAAGTTGCCCTACAATATTTTGAAACTGAGTGGGAAATCCAGGTACTGGG<br>TGGGTTGAAAGNNNNNNNNNNNNNNNNNNNNNNNN |
| | LE<br>(SEQ ID<br>NO: 1079) | CCTTTATCACCAAAGTATTCAATATTTTCTCTTAACCGAACTTTACTGTTTTTAAGTATGCAAAAATTATTGTACATT<br>AACTAATTATTTGTCATTGTACAAAAATGTACAGTGACTAATTATATGTCGTCGAGACAAATTAATGTCATCCATTA<br>AAATCTTGCTCGGTATAGGTTACAGCGTTTTAGTAGTATTAGGATAACATCTTGACAGTGACAGATTAGCTGTCATT<br>TTGGGTAATAGTGACAAATTAGCTGTCGCTTCATCAGAGATAAAAAAGCTTTTGTGTATTTTCATAATGACAAATTG<br>ACTGTCGCTTTCTGTTTAAGTAGAATAACAATATGTTTTTATAAAAAAGCTTCGCATTATGAACAGTCAGCAAAATC<br>CTGATTTAGCTGTTCATCCCTCGGCAATTCCTATAGAAGGCTTACTAGGAGAAAGCGATATAACTCTTGAGAAGAAT<br>GTAATTGCCACACAACTCTCAGAGGAAGCCCAACTCA |
| | RE<br>(SEQ ID<br>NO: 1080) | GCAAATCTGAAATCATTACGCACGCATACAAAAATGTTTTAATAACCTGCCAGGTACTAGGTGGGTTATCATAATTT<br>TTATTAGGGAGGGTTGAAAGAGAGCGCTACGTTGACATTATCGCTATAGTCTCTGTAAATAAATGACATTAATCTGT<br>CACTGGCACCTAAACGACATCAATTCGTCCCGACGACAGTTAATTAGTCCCAACGACATTAATCTGTCACCGACGAC<br>AAATAATTAGTCACTGTACAAAAAAAATGGACGTAACTGGATTCGAACAGTGACCTCTACGATGTCAACGTAGCG<br>CTCTAACCAACTGAGCTATACGTCCTTAACCACACGAATATTGATAGTAGCATATACTTTTGCGATCGCACAAGATA<br>AGACCCAAGCTTTTTAAGGGGGTTTTAGATTTTGAGTGCGTAAATCCTAATTTCAAATAAAATCCTTATATTTTCGT<br>TACAATCAGCTTGTGCGTTAAGCATTCAAGAGTTATCA |
| CP001701/<br>Cyanothece<br>sp.<br>PCC 8802/<br>T46 | TnsB<br>(SEQ ID<br>NO: 1081) | ATGAACACATTCCCCAACGAGCAGAGCAACGCCATCGTGCTGAAGAACACCATCGTGTCCGACCTGCCTGAGACAG<br>CCAGAGCCAAGATGGAAGTGATCCAGACACTGCTGGAACCCTGCGACAGAACCACCTACGGCGAGAGACTTAGAG<br>AGGGCGCCAAGAAACTGGGAGTGTCTGTGCGGACAGTGCAGCGGCTGTTCAAGCAGTACCAAGAGCAAGGACTGG<br>CCGCTCTGGTGTCCATGGAAAGAGCCGATAAGGGCAAGCACCGGATCAACGAGTTCTGGCAGGACTTCATCGTGAA<br>AACCTACCAGCAGGGCAACAAGGGCAGCAAGCGGATGACCCCTAAACAGGTGGCCCTGAAGGTGCAGGCCAAGGC<br>TCTGGAAATCGGCGACGAACAGCTCCTACCTATCGGACCGTGCTGAGAGTGCTGAAGCCCATCCAAGAGAAGCAA<br>GAAAAGACCAAGTCCATCAGAAGCCCCGGCTGGCGGGATCTACACTGAGCGTGAAAACAAGAGATGGCGACGAC<br>CTGGAAATCAACTACAGCAATCAAGTGTGGCAGTGCGACCACACCAGGGCCGATGTTCTGCTGGTGGATAGACACG<br>GCGAGCTGATCGGTAGACCTTGGCTGACCACCGTGATCGACAGCTACAGCAGATGCATCATGGGCATCAACCTGGG<br>CTTCGACGCCCCTAGTTCTCAGGTTGTGGCACTGGCCCTGAGGCACGCCATTCTGCCTAAGAGATACGGCGACGAGT<br>ACAAGCTGCACTGCGAGTGGGAGACAAGCGGCACCCCTGAGTACTTCTACACCGACGGCAAGGACTTCAGAAG<br>CAACCATCTGGCCCAGATCGGCAGCCAGCTGGGATTCGTGCACAAGCTGAGAGACAGACCTAGCGAAGGCGGCATC<br>GTGGAAAGACCCTTCAAGACCCTGAACCAGAGCCTGTTCAGCACCCTGCCTGGCTACACAGGCAGCAACGTGCAAG<br>AGAGGCCTAAAGAGGCCGAGAAAGAGGCCAGCCTGACACTGAGAGAGCTGGAACAGCTGATCGTGCGGTTCATCG<br>TGGACAAGTACAACCAGAGCATCGACGCCCGGATGGGCGACCAGACAAGATACCAGAGATGGGAGGCCGGACTGA<br>GAAGGCAGCCTATCAGCGATGCGCGAGCTGGATATCTGCCTGATGAAGGCCGCTCGGAGAACAGTGCAGA<br>GAGGCGGCTATCTGCAGTTCGAGAACGTGATGTACCGGGCGAGTACCTGGAAGGCTATGCCGGCGATACCGTGAT<br>CCTGAGATACGAGCCCAGAGACATCACCACCATCTGGGTGTACCGGCAGAAAAAGCACCAAGAGGTGTTCCTCACC<br>AGAGCACATGCCCAGGATCTGGAAACCGAGCAGCTGTCTGTGGACGAGGCCAAAGCCTCTGCCAAAAAACTGAGA<br>GATGCCGGCAAGACCATCAGCAACCAGTCCATCCTGCAAGAAGTGATCGAGAGAGGGCCCTGGTCGAGAAGAAG<br>TCCCGGAACAGAGACAGAAGGCCGAGCAGGCCTACAAGCAAGAGAAACAGCCCAGCATCATCGAGACAGTGGAA<br>CCCATTGAGCCCGAGCCTCTGACACAGACCGAGGTGGACGATATCGAAGTGTGGGACTACGACCAGCTGCGGGACG<br>ATTATGGCTGGTGA |
| | TnsC<br>(SEQ ID<br>NO: 1082) | ATGACACAGGCCCAAGAGATCGCCCAGAAGCTGGGCGACCTGAATCCTGATGAACAGTGGCTGCAGATGGAAATC<br>GCCCGGCTGAACAGACAGAGCATCGTGCCCCTGGAACACATCAGGGATCTGCACGAGTGGCTGGACGGCAAGAGA<br>AAGGCCAGACAGTCCTGTAGACTCGTGGGCAGAGGACAGAACCGGAAAGACCGTGGCCTGCAGAAGCTACACACTG<br>CGGAACAAGCCCATCCAGCAGGGCAGACAGACACCATTGTGCCCGTGGTGTACATCATGCCACCTTACCAAGTGCG<br>GCAGCAAGGACCTGTTCAAAGAGATCATCGAGTACCTGCCGGTACAAGGCCGTGAAGGGCACCGTGTCCGAGTTCAG<br>ATCCAGAGCCATGGAAGTGCTGAAGGGCTGCGAGGTGGAAATGATCATCGACGAGGCCGACCGGCTGAAGCC<br>CGACACATTTCCTGATGTGCGGGACATCAACGACAAGCTGGAAATCAGCGTGGTGCTCGTGGGCAACGACAGACTG<br>GATGCCGTGATCAAGCGGGACGAACAGGTGTACAACCGGTTCAGAGCCCACAGAAGATTCGGCAAGCTGGCCGGC<br>GTGGAATTCAAGAAAACAGTGGCCATCTGGGAAGAGAAGGTGCTGAAGCTGCCCGTGGCCAGCAATCTGACAAGC |

TABLE 27-continued

| Name/Organism/System ID (T) | | Sequences |
|---|---|---|
| | | AGCGCCCTGATCAAGATCCTGGTCAAGGCCACCGAGGGCTACATCGGCAGACTGGACGAGATTCTGAGAGAGGCCG<br>CCATCAAGAGCCTGATGAAGGGCCACAAGCGGATCGAGAAAGAGGTGCTGCAAGAGGTCGCCAAAGAGTACAGCT<br>GA |
| | TniQ<br>(SEQ ID<br>NO: 1083) | ATGAAGGCCACCGACGAGATCAAGCCTTGGCTGTTCGCCGTGGAACCTATCGAGGGCGAGAGCCTGTCTCACTTCCT<br>GGGCAGAGTGCGGCGGAGAAACCACCTGTCTCCATCTGCTCTGGGACAGCTGGCCGGAATCGGAGCCAAAATTGCC<br>AGATGGGAGCGCTTCCACCTGAATCCATTTCCAAGCGACGCCGACCTGAAGGCCCTGGGAGAAATCGTTGGAGTGG<br>AAGGCAAGCGGCTGCGGCTTATGTTGCCTCCTAAGGGCGAAAGAATGATGTTCGACCCCATCAGACTGTGCGCGC<br>CTGTTATGCGCAAGTGCCCTGTCACAAGATCGAGTGGCAGTTCAAGAGCGTTTGGAGATGCGAGAAGCACAGCCTG<br>AAGCTGCTGAGCAAGTGCCCCAACTGCCGGAAGAAGTTCAAGATCCCCGCTCTGTGGGAGTTCGGCGAGTGCGATA<br>GATGCCGGCTGAGCTTCCAAGAGATCCGGTGA |
| | Cas12k<br>(SEQ ID<br>NO: 1084) | ATGAGCACCATCACCATCCAGTGCAGACTGGTGGCCCCTGAGGCTACAAGACAGGCTCTGTGGCAGCTGATGGCCC<br>AGAAAAACACCCCCTCTGGTGTCCAGCTGCTGAGACAGGTTGCCCAGCATCCTGACTTCGAGACATGGCGGCAGCA<br>GGGAAAACTGGAAGCCGGCATCATCAAGAAGCTGTGCGAGCCCCTGAAGAAGGACCCCAGATTCTACGAGCAGCC<br>CGCCAGGTTTTACACCAGCGCCATTAGCCTGGTGGACTACATCTACAAGAGCTGGCTGAAGGTGCAGCGGCGCTG<br>CAGAACAAACTCGAGGGCAGAATCGGTGGCTGGTCATGCTGAAGTCCGACGAGGAACTGGTGCAGATCAGCCAG<br>AGCAGCCTGGAAACCATTCAGGCCAAGGCCACCGACATCCTGAGCACCCTGAAGCCTGAGAAGCCCGACAAGTTCC<br>CCGAGACAAGCACCACCAAGGGCAAGAAGTCCAAGAAGTATAAGAACAACAACAGCCTGTTCACCCAGCTGTACA<br>ACCTGTACGAGAAGGCCGACGACACCCTGACACACTGCGCCATCGATACCTGCTGAAGAACGGCTGCAAGATCCC<br>TCAGAAGCCAGAGGACCCTGAGAAGTTCGCCCAGCGGAGAAGAAAGGTGGAAATCAAGATCGAGCGGATCATCGA<br>GCAGATCGAGAGCAGCATCCCTCAGGGCAGAGATCTGACAGGCGACAGCTGGCTGGAAACCCTGATCATTGCCGCC<br>AATACCGCCACCGTGGAAGCCAGCGAGATCAAGTCCTGGCAGGACAAGCTGCTGTCCCAGAGCAAGAGCATCCCCT<br>ATCCTGTGGCCTACGAGACAAACGAGGACCTGACCTGGTCCATCAACGAGAAGGGCAGACTGTGCGTGCGGTTCAA<br>TGGCCTGGGCAAGCACACCTTCCAGATCTACTGCGACCAGCGGCAGCTGAAGTGGTTCCAGAGGTTCTACGAGGAT<br>CAGCAGATCAAGAGAGCAGGCAAGGACCACCAGCAGCGCCCTGTTTTCTCTGAGAAGCGGCCGGATCGTGTGGC<br>AAGAAGGCCTCGGAAAGGGCAAGCCCTGGAACATCCACAGACTGACCCTGCACTGTAGCCTGGACACCCGGTTTTG<br>GACCGAAGAGGGCACACAGCAGGTCCAGCAAGAGAAAAGCAAGAAGTTCCAGACCAACCGGCTGCGGATGAAGCC<br>CGAGCTGACCTTCTCCATCTTCTTCAGATCTCAGACCCTCGAGACATACCTGCAAGTGTGGCTCGTGATCACCGCCT<br>ACAGACTGGACGAGCTTCCTGGACAAGGGCAACGTGGCAAAGGCCCACCAAGAGTTTCAGAAGGCCATCAAGCGGA<br>ACGAGTCCAGCCTGCAGAAGATCACCAGCAGCTACAACAGACCCCACAAGACCCTGTACCAGGGCAAGTCCCACAT<br>CTTTGTGGGCGTTGCCATGGGCCTGAGAAGCCTGCTACAGTGGCTGTGGTCGATGGCACCACAGGCAAGGCTATC<br>GCCTATCGGAGCCTGAAACAGCTGCTGGGAAACAACTACCACCTGTTCAACAGACAGGGCAAGCAGAAGCAGAAC<br>ACAAGCCACCAGAGACAAGAGCCAGAAGCACTTCGCCGACAACCAGTTCGGCGAGTCTCAGCTGGGCCAGTAC<br>ATCGATTGCTGCTGGCCAAAGCCATCATCAGCGTGGCCCAGACATACTGCGCCGGCTCTATTGTGGTGCCCAAGCT<br>GAAGGACATGAGAGAGCTGATCCAGAGCGAGATCCAGGCTAAGGCCGAGGCCAAGATTCCCGGCTATGTGGAAGG<br>ACAGGCCAAATACGCCAAGAGCTACAGAGTGCAGGTCCACCAGTGGTCCCACGGCAGACTGATGACAACATCACA<br>AGCCAGGCCAGCAAGTTCAACATCACTGTGGAAGAGGGCGAGCAGCCTCACCAGGGAAACCCTCAGGATAAGGCC<br>AAACTGCTGGCAATCGCCGCCTACCACTCTAGGCGTGTGTGCTTGA |
| | TracrRNA<br>(SEQ ID<br>NO: 1085) | AGCTCAAATATTGCACCTTGAAAATTAAATACGTTAGGATTGGTATTAATCGCGCCGTAGTTCATGTTCTTTTGAACC<br>AATGTGCTGCGCTAAGTATGGGTTAGTTTGCCTGTTGGTTAAACAGGTGTGCTTTCTGGCCCTGGTGACTGCTCGCCC<br>TGATGCTGATTTCTACACTTCATAGGCGTAGGAATGATTAACTCGTAAGTTGATGTTAAATGCTACTTTAATTTTACG<br>GGGTCGGTGCGCTCCCAGCAATAGGGGTGTGGACATACCTCAGTAGTTGTCACTGAATCACCTCCGAGCAAGGAGG<br>AATCCATCCTTATTTTTCCTTTTTGACGGGGGAAAGCGAGGGCAAAATCCCTGGAGTCCCGTCAGAATCCTGAAAGT<br>CTTACCTAGACTTGATTATAGAGTTTATTGTGGATGGTCATGCCAGATTCTACAAGTTGTAAAACATCATATTTTGGA<br>GACCCATCAGAATTGTTTCTAAAATTGAGTGTTAAAAAGGCTTTTAGCTGACGGA |
| | DR<br>(SEQ ID<br>NO: 1086) | GTTTCAACGACCATTCCCAACAGGGATGGGTTGAAAG |
| | TracrRNA<br>(SEQ ID<br>NO: 1087) | AGCTCAAATATTGCACCTTGAAAATTAAATACGTTAGGATTGGTATTAATCGCGCCGTAGTTCATGTTCTTTTGAACC<br>AATGTGCTGCGCTAAGTATGGGTTAGTTTGCCTGTTGGTTAAACAGGTGTGCTTTCTGGCCCTGGTGACTGCTCGCCC<br>TGATGCTGATTTCTACACTTCATAGGCGTAGGAATGATTAACTCGTAAGTTGATGTTAAATGCTACTTTAATTTTACG<br>GGGTCGGTGCGCTCCCAGCAATAGGGGTGTGGACATACCTCAGTAGTTGTCACTGAATCACCTCCGAGCAAGGAGG<br>AATCCATCCTTATTTTTCCTTTTTGACGGGGGAAAGCGAGGGCAAAATCCCTGGAGTCCCGTCAGAATCCTGAAAGT<br>CTTACCTAGACTTGATTATAGAGTTTATTGTGGATGGTCATGCCAGATTCTACAAGTTGTAAAACATCATATTTTGGA<br>GACCCATCAGAATTGTTTCTAAAATTGAGTGTTAAAAAGGCTTTTAGCTGACGGAGAAATTCCCAACAGGGATGGG<br>TTGAAAGNNNNNNNNNNNNNNNNNNNNNNNNNN |
| | LE<br>(SEQ ID<br>NO: 1088) | TCTCCTAAATTCGTTAACTTAATCTATATATCCTAACTTACTCAAAAAGTCATTTAACTCCCCTAAAGTCTCCTCTCG<br>CTGCGCTTCCAACTCCTGTACAGTGACTGACACATTGTTTGTCATCGGTGACAGATTAGTGTCGTCTTTTAAAGACCTTACT<br>CAATAAGCTTACGTCCATTTTACACTCATTTGTACTATTTTTGTTTGGTGACAAAATAAGTGTCGCTTTTTGCTTTT<br>ATGACAAATTAATTGTCGTTTTTTCATAAAGCTTCAAAAATAATTGTGACAAATTCCATGTCACTTTTTCTATAAATG<br>TCTGCTAAAATAACATTATGGTTTTAAAATAGTGTTCTAATTATGAGATGAATACTTTTCCTAATGAGCAGTCTAAT<br>GCAATTGTACTAAAAAATACCATTGTATCGGATTTGCCAGAAACGGCACGGGCTAAAATGGAGGTCATCCAGACACT<br>TCTAGAACCCTGCGATCGCACAACTTACGGAGA |
| | RE<br>(SEQ ID<br>NO: 1089) | GTTTCAACGACCATTCCCAACAGGGTGGGTGAAATATAGTCTCAATATTTTCAATGTTAAGATGGATTGAAAGGCG<br>CACTTCGTTCGGGAACATACTATCGAAGTATTAAAGATAAATGCCAATGCTCAGATCATGACAATTAATTTGTCACC<br>AGTGCTTAAACGACAGCAATTTGTCACAAAGACAGTTAATTTGTCTCCACGACACTAATCTGTCACCGATGACAAAT<br>AATATGCTGTACAAATCGGGATGACAGGATTTGAACCTGCCAGCCCCCTTCGTCCCGAACGAAGTGCGCTACCAA<br>GCTGCGCTACATCCCGTAAAATTAAACAGCATTTCTATTATAGCACGATCGCCCCTAAGACTCTATCCCTCGCAAA<br>CTTTAATGAACTGCCGATCAAGAGCCCCTACCCAGAATGATAAGCTAACAGATGGACTAAAATTCGTCAGTAAGCT<br>ACTATGACTCAAGGTAATAATACCCCCTATTTACTCCGTG |
| CP003610/<br>Calothrix<br>sp./T47 | TnsB<br>(SEQ ID<br>NO: 1090) | ATGTCCGTGTTTGCCCTGATGGCCGACAAGAAGTTCGAGCTGACCGAGAAGTTCACCCAGCTGCCTGAGGCCGTGTT<br>TCTGGGCGAGAACAACTTCGTGATCGACCCCAGCCAGATCATCCTGGAAACCAGCGACAAGCACAAGCTGACCTTC<br>AACCTGATGCAGTGGCTGGCCGAGTCTCCCAACAGAACCATCAAGAGCCAGCGGAAGCAGGCCATTGCCTCTACAC<br>TGGGCGTGTCCACCAGACAGGTGGAAAGACTGCTGAAGCAGTACGACGAGGACCGGCTGTCTGAGCACATCTGGCCT<br>GCAGAGAAGCGACAAGGGCAAGTACAGAGTGTCCGACTACTGGCAAGAGTTCATCAAGACCACCTACGAGAAGTC |

TABLE 27-continued

| Name/<br>Organism/<br>System<br>ID (T) | Sequences |
|---|---|
| | CCTGAAGGACAAGCACCCTATCAGCCCCGCCTCTATCGTGCGGGAAGTGAAGAGACACGCCATCGTGGACCTGAAG<br>CTGGAACAGGGCAACTACCCTCATCCTGCCACCGTGTACCGGATCCTGAATCCTCTGATCGAGCAGCAAGAGCGGA<br>AGAAAAAAGTGCGGAACCCTGGCAGCGGCAGCTGGATGACAGTGGAAACAAGAGATGGCAAGCAGCTGAAGGTGG<br>ACTTCAGCAACCAGATCATTCAGTGCGACCACACCAAGCTGGACATCCGGATCGTGGATAGCGACGGCATCCTGCT<br>GACCGAAAGACCTTGGCTGACCACCGTGGTGGATACCTTCTCCAGCTGCGTGAACGGCTTTCACCTGTGGATCAAGC<br>AGCCTGGCTCTGCCGAAGTGGCTATCGCCCTGAGACATGCCATCCTGCCTAAGCAGTACCCCGACGATTACGAGCTG<br>GGCAAGCCCTGGAAGATCTACGACACCCCTTCCAGTACTTTTTCACCGACGGCGGCAAGGACTTCAGATCCAAGC<br>ACCTGAAAGCCATCGGCAAGAAACTGGGCTTCCAGTGCGAGCTGAGAGACAGACCTATCCAAGGCGGCATCGTGGA<br>ACGGATCTTCAACACCATCAACACCCAGGTGCTGAAGGACCTGCCTGGCTACACAGGCCCCAATGTGCAAGAGAGG<br>CCTGAGAACGCCGAGAAGAGGCCTGTCTGTCCATCCACGACCTGGACAAGATCCTGGCCAGCTTCTTCTGCGACAT<br>CTACAACCACGAGCCTTATCCTAAGGACACCCGGATCACCAGATTCGAGCGGTGGTTCAAAGGCATGGGAGAGAAG<br>CTGCCCGAGCCTCTGAATGAGAGAGAGCTGGATATCTGCCTGATGAAGGAAGCTCAGAGAGTCGTTCAGGCCCACG<br>GCAGCATCCAGTTCGAGAACCTGGTGTACAGAGGCGAGAGCCTGAATGCCCACAAGGGCGAGTATGTGACCCTGAG<br>ATACGACCCCGACCACATCCTGACACTGTACGTGTACGACTACGACGTGAACGACGAGCTGGAAAACTTCCTGGGC<br>TACGTGCACGCCATCAACATGGACACACAGGACCTGAGCCTGGAAGAACTGAAGTCTCTGAACAAAGAGCGGAGC<br>AAGGCCAGAAGAGAGCACAGCAATTACGACGCCCTGCTGGCCCTGAGCAAGCGGAAAGAACTGGTGGAAGAGAGA<br>AAGCAGGGCAAGAAAGAGAAGCGGCAGGCCGAGCAGAAGAGACTGAGAGCCGCCAGCAAGAAAAACAGCAACGT<br>GGTGGAACTGCGGCAGAACAGAGCCAGCAGCAGCTCCAACAAGGACGAGAAGGATGAGAAGATCGAACTGCTGCC<br>AGAGCGGGTGCTCCCGCGAGGAACTGAAAGTGGAAAAGATCGAGCCTCAGCTGGAAATCTGGATAAGGCCGAGAC<br>ACCTCCTCAAGAGCGGCACAAGCTCGTGATCAGCAGCAGAAAGCAGCACCTCAAAAAGATCTGGTGA |
| TnsC<br>(SEQ ID<br>NO: 1091) | ATGGCCAGATCTCAGCTGGCCATCCAGAGCAGCGTGGAAGTGCTGGTTCCTCAGCTGGACCTGAATGCCCAGCTGG<br>CTAAGGTGGTGGAAGTGGAAGAGATCTTCAGCAACTACTTCATCCCCACCGACAGAAGCAGCGAGTACCTGAGATG<br>GCTGGACGAGCTGCGGATCCTGAGACAGTGTGGCAGAGTGATCGGCCCCAGAGATGTGGGCAAGTCTAGAGCCAGC<br>CTGCACTACCAGGGCCAAGACCAGAAGCGGATCAGCTAGCTCAGAGCTTGGAGCCGCAGCAGCAGCAAGAGACTG<br>TTCAGCCAGATCCTGAAGGACATCAAGCACGCCGCTCCTATGGGCAAGCGCGACGATCTTAGACCTAGACTGGCCG<br>GCTCTCTGGAAGTGTTCGGCTTCGAGCAAGTGATCATCGACAACGCCGAGAACCTGCAGAAAGAGGGCCCTGCTGGA<br>TCTGAAGCAGCTGTTCGACGAGTGCCACGTGCCAATCGTGCTGATCGGAGGCCAAGAGCTGGACACCATCCTGGAC<br>GAGTTCGACCTGCTGACCTGCTTTCCCACACTGTACGAGTTTGACGGCCTGGATGAGAACGACTTCAAGAAACCCT<br>GAACACCATCGAGTTCGATATCCTGGCTCTGCCCGAGGCCAGCAATCTGTCTGAGGGCATCATCTTCGAGCTGCTGG<br>CCGAGTCTACAGGCGCCAGAATTGGCCTGCTGGTCAAGATCCTGACAAAGGCCGTGCTGCACAGCCTGAAGAACGG<br>CTTCTCCAAGATCGACCAGAACATCCTGGAAAAGATCGCCAACAGATACGGCAGACGGTACATCCCTCCTGAGAAG<br>CGGAACAACAAGTGA |
| TniQ<br>(SEQ ID<br>NO: 1092) | ATGGCCGAGGACATCTACCTGCCTAAGAGAGAGATCATCAGCAACAAAGAGATCAACAAGGGCGACGAGATCCTG<br>CCTAGACTGGGCTTCGTGGAACCCTACGAGTGCGAGACCACTACCTGGGCAGGTGCGGAGATTCAAGG<br>CCAACAGCCTGCCTAGCGGCTACGACCTGGGAAAGATCGCCGGAATTGGCGCCGTGACCACCAGATGGGAGAAGCT<br>GTACCTGAATCCATTTCCTAGCGAGACAGAGCTGGAAGCCCTGGCCAAAGTGATCGAGGTGGAAGTGGAACGGCTG<br>CGGCAAATGCTGCCTCCTAAGGGCATGACCATGAAGCCCAGACCTATCAGACTGTGCGCCGCCTGTTATGCCGAGTC<br>TCCCCACCACAGAATCGAGTGGCAGTTCAAGGACGTGATGGTCTGCGACAGACACCAGCTGCCTCTGAGCACCAAG<br>TGCAAGAATTGCGGCACCCCTTTTCCAATACCTGCCGATTGGGTTCGAGGCGAGTGCCCTCACTGCTGCCTGAGCTT<br>TACCAAGATGGCCAAGCGGCAGAAGTCCGGCTAA |
| Cas12k<br>(SEQ ID<br>NO: 1093) | ATGAGCGTGATCACCATCCAGTGCAGACTGGTGGCCGACGAAGAGACACTGAGACACCTGTGGACACTGATGGCCG<br>AGAAAAACACCCCTTTCGCCAACGAGATCCTGGAACAGCTGGCCCAGCACGCCGAGTTTGAGAGCTGGGTCAAGAA<br>CAGCAGAGTGCCCGCCACCGTGATCAAAGAGCTGTGCGACAGCCTGAAGAATCAAGAGCTGTTCGCCGGCCAGCCA<br>GGCAGATTCTACACAAGCGCCACAACACTGGTCACCTACATCTACAAGAGCTGGCTGGCTGTGAACAAGCGGCTGC<br>AGAGAAAGATCGAGGGCAAGAAACAGTGGCTGGACATGCTGAGAAGCGACACCGAGCTGGAACAAGAGAGCAAC<br>AGCAACCTGGAAAGATCAGAGCCAAGGCCACCGAGATTCTGGATAGCTTCGCCACCAGACAGATCAATCAAGTGA<br>ACAGCAAGAGCAAGACCTCTAAGAACAACAAAAACAAGCAAGAGAAAGAAGTGAAGTCCCTGAGCATCCAGAGCA<br>ACATCCTGTTCGAGACATACCGGCAGACCGAGGACAACCTGACCAAGTGCGCCATCGTGTACCTGCTGAAGAACAA<br>CTGCGAAGTGAACGACGTGGAAGAGGACATCGAGGAATACGAGAAGAACAAGCGCAAGAAAGAGATCCAGATCA<br>AGCGGCTCGAGGACCAGCTGAAGTCCAGAGTGCCTAAGGGCAGAGATCTGACCGGCGAGAATTGGGTCGAAGTGC<br>TGGAAAAGGCCGTGAACAGCGTGCCCGAGTCTGAGAATGAGGCCAAGTCTTGGCAGGCCAGCCTGCTGAGAAAGTC<br>CTCTCAGATCCCATTTCCTGTGGTGTACGAGACAAACGAGGACATCAAGTGGTCCATCAACGAGAAAGGCCGGATC<br>TTCGTGTCCTTCAACGGCCTGGGCAAGCTGAAGTTCGAGATCTTCTGCGACAAGCGGCATCTGCACTACTTCCAGCG<br>GTTTCTGGAAGATCAGGACATTAAGCGGCAGGGGAAGAACCAGCACAGCAGCAGCTGTTCACCCTGAGATCCGGC<br>AGAATCTCTTGGCTCGAGCAGCCTGGCAAGGGCAAGCCCTCAGCAATCAATAGACTGCTGCTTTTCTGCAGCATCGA<br>CACCCGGATGCTGACAGCCGAGGGAACCCAGCAAGTGATCGAAGAGAAGATCGCCGACACACAGAACAAGATCGC<br>CAAGGCTCAAGAGAAGTGCGAGGGCGAGCTGAACCCTAATCAGCAGGCCCACATCAACCGGAAGAAGTCCACACT<br>GGCCCGGATCAACACCCCATTTCCAAGACCTAGCAAGCCCCTGTACCAGGGCAAGAGCCATATCGTTGTGGGCGTG<br>TCCCTGGGCCTGAAAGCCACAGCTACAATCGCCGTGTTCGACGCCATGAACAACCAGGTGCTGGCCTACAGAAGCA<br>CCAAACAGCTGCTGGGCGACAACTACAAGCTGCTGAACCGGCAGCAACAGAGAGCAGAGACTGAGCCAGCAGC<br>GGCACAAGAGCCAGAAGCAGTTCGCCAGCAATAGCTTCGGCGAGAGCGAACTGGGCCAGTACGTTGACAGACTGCT<br>GGCCAAAGAAATCGTGGCCGTGGCCAAGAATTTCGGACCCGGCAGTATCGTGCTGCCCAAGCTGGGAGACATGAGA<br>GAGATCATCCAGTCCGAGGTGCAGGCCAAGGCCGAGAAGAAGATCCCTGGCTTCATTGAGCTGCAGAAGAACTACG<br>CCAAAGAGTACAGAAAGAGCGCCCACAATTGGAGCTACGGCCGGCTGATCGAGAATATCCAGTCTCAGGCCACCAA<br>AGAGGGGATCGAGATCGAGACAGGCAAGCAGCCCACACGGGAATCCCACAAGAACAGGCTAGAGATCTGGCCCT<br>GTTTGCCTACCAGTGCCGGATTGCTTGA |
| TracrRNA<br>(SEQ ID<br>NO: 1094) | TGAAATTAAATAAAATACAGAACCTTGAAAACTTAATATGAAATAAATAGCGCCCAGTTCATACTCTTTGAGCCA<br>ATGTACTGCGATAAATCTGGGTTAGTTTGACGGTTGGAAAACCGTCTTGCTTTCTGACCCTGGTAGCTGCCCGCTCTT<br>GATGCTGCTGTCTGCTTTGACTAGACAGGATATGCCTTTTTTGCAATTTAGTTGGATAAACAGTTTTTTATGTTTTTA<br>GCGACAGTGAAAAACTTTTATACAAGTATATCAAATAGGGACAGGTGCGCTCCCAGCAATAAAGAGTACAGATGCA<br>AATCTGGAGCCGTTTTATTACGGTGGGGATTACCTCAGCGGTGGTTACTGAATCACCCCCTTCGTCGGGGGAACCCT |

TABLE 27-continued

| Name/Organism/System ID (T) | | Sequences |
|---|---|---|
| | DR (SEQ ID NO: 1095) | CTCAAATCTTTTTTTGGCGCGTCGAAGCGGGGGCAAAATCCCTGGACTCCCGCCAAAATCTCAAAACTCTTGCCCTG<br>TATTAATTTGAAGGAACTGAGTATCAATTGATTTAGTTTTTTCATTTTCAAGTGGAGATGCTTTTAGGTAGTCCTGAC<br>AAATGTGCAGTTTAAAAGCTTCAATAGTAAGGGTTTCAGACGGTCGG<br>GTTTCAACTACCATCCCGACTAGGGGTGGGTTGAAAG |
| | sgRNA (SEQ ID NO: 1096) | TGAAATTAAATAAAATACAGAACCTTGAAAACTTAATATGAAATAAATAGCGCCGCAGTTCATACTCTTTGAGCCA<br>ATGTACTGCGATAAATCTGGGTTAGTTTGACGGTTGGAAAACCGTCTTGCTTTCTGACCCTGGTAGCTGCCCGCTCTT<br>GATGCTGCTGTCTGCTTTGACTAGACAGGATATGCCTTTTTTGCAATTTAGTTGGATAAACAGTTTTTTATGTTTTTA<br>GCGACAGTGAAAAACTTTTATACAAGTATATCAAATAGGGACAGGTGCGCTCCCAGCAATAAAGAGTACAGATGCA<br>AATCTGGAGCCGTTTTATTACGGTGGGGATTACCTCAGCGGTGGTTACTGAATCACCCCCTTCGTCGGGGGAACCCT<br>CTCAAATCTTTTTTTGGCGCGTCGAAGCGGGGGCAAAATCCCTGGACTCCCGCCAAAATCTCAAAACTCTTGCCCTG<br>TATTAATTTGAAGGAACTGAGTATCAATTGATTTAGTTTTTTCATTTTCAAGTGGAGATGCTTTTAGGTAGTCCTGAC<br>AAATGTGCAGTTTAAAAGCTTCAATAGTAAGGGTTTCAGACGGTCGGGAAATCCCGACTAGGGGTGGGTTGAAAGN<br>NNNNNNNNNNNNNNNNNNNNN |
| | LE (SEQ ID NO: 1097) | AATTGCAGTGGGATGAGAGGGTTCTAGATAGCTGATAGGAGTTACAGGATACCACTGTTTAGTCCAGGAAAAGTTA<br>GTCATCATCAAATTAACTAATTTATTCGACTCAAATTTGAAAAATGAGTAAAAAGCGGCATTTAATGTGCAATGTT<br>GTACATTCGCACATTATATGTCGCTTTTCGCAAGTTAGGTCGCAACCGCATTTAACTGCTATAAACCCTATTTTACAA<br>AGGTTTGATGCTCTTAGCACATCAAGCCCACGAATTTACTTAATTCGACATATTCCATGTCGCAAACTAAATATTCGC<br>AAATTGAATGTCGTTTATTAAAATTTGTCACTTCGCAAATTGTTTGTCGTATTATTGAGCGATTCATGGTACATTGGT<br>ACTCTAATGAGTGTTTTTGCTCTAATGGCAGACAAAAAATTTGAATTGACAGAAAAATTTACACAACTTCCTGAAGC<br>TGTTTTTCTTGGCGAGAATAATTTCGTAATAGATCCA |
| | RE (SEQ ID NO: 1098) | ATCAGACTCTTAAATTTAAGTGATAGAGATAATATTTAAGCACAGATATATTTCTTACTCAGCAATAGCATTTAGTATT<br>TGCATGGAAATAAATAGCTTTGAGCAACATTAATTTGTTAACGATGTCTTTGAGGATTTAGGGGACATCAATTTGT<br>TAAAAAGACATTAATTTTTGTTAACGACGACAAATTATTTGTAATCGACTTTAGGACAAATAAATTTGTCGCTTTATG<br>TACTTTGACAAATAATGTGTCGCTCTACATCAGTTAATCGACAATAACCAAGCGACGTTAATTTGCGAAAACCTATA<br>ATCATCAATATAGTACACAAATCTGTCGAAAGCGACACTAATTTGCTAATAACGACACTAATGTGCGAAAAGCGAC<br>ATTTAATGTGCGAAAGTACAAATGTACAAAATGGGCGACCTGGGGCTCGAACCCAGAACCAGCAGATTAAGAGTCT<br>GATGCTCTACCATTGAGCTAGTCGCCCTCACCATTTACT |
| CP003620/<br>Crinalium<br>epipsammum<br>PCC 9333/<br>T48 | TnsB (SEQ ID NO: 1099) | ATGGCCACCGACAATCCTAATGCCAGCGGCATCGTGACCGAGCTGTCTCACGAGGCCAAGCTGAAGCTGGAAATCA<br>TCGAGAGCCTGCTGGAACCCTGCGACAGACAGACATACGGCGAGAGACTGAAGGACGCCGCCAAGAAACTGGGCA<br>AGTCTGTGCGGACAGTGCAGCGGCTGGTGCAGAAATGGGAAGCCGAAGGACTGCTGGCCCTGACCGGAACACAGA<br>GAGTGGATAAGGGCAGACACCGGCATCAGCCAGGACTGGCAGGACTTCATCATCAAGACCTACCGCAGCGGCACA<br>AGGGCAGCAAGCGGATGAGCAGAAAACAGGTGGCCCTGAGAGTGGAAGTGCGGGCCAAAGAACTGGGCGACGAG<br>GACTACCCCAACTACCGGACAGTGTACAGAGTGCTGCAGCCCCTGATTGAGGCCAAGAACAGAAAAAAGGCGTGC<br>GGACACCTGGCTGGCGAGGCTCTCAACTGAGCGTGAAAACCAGAACCGGCGACGACATCAGCGTGGAATACTCCAA<br>CCACGTGTGGCAGTGCGACCACACATGGGTTGACGTGCTGGTGGTGGATATCGAGGGCGAGATCATCGGCAGACCT<br>TGGCTGACCACCGTGATCGACACCTACAGCGATGCATTCCTGGGCATCAGAGTGGGCTTCGATGCCCCTAGTTCTA<br>GCTGGTTGCCCTGGCTCTGAGCACACGCCATGCTGCCCAAGAATTACGGCACCGAGTACGAGCTGCACTGCCAGTGG<br>GGCACATATGGCAAGCCCGAGTACCTGTTTACCGACGGCGGCAAGGACTTCAGAAGCGAGCACCTGAAGCAGATCG<br>GCGTGCAGCTGGGCTTCACCTGTATCCTGAGAGACAGACCTAGCGAAGGCGGCGTGGTGGAAAGACCTTTCGGCAC<br>CCTGAACACCGAACTGTTTGCCGGCCTGCCTGGCTACGTGGGCTCTAACGTTCAGCAGAGGCCTGAGCAGGCCGAG<br>AAAGAGGCTTGTCTGACCCTGCCTGAGCTGGAAAAGCGGATCGTGCGGTACATCGTGGACAACTACAACCAGCGGA<br>TCGACAAGAGAATGGGCGACCAGACCAGATACCAGAGTAGGGACGCTGGCCTGCTGGCCACCACCTGATCTGATCGG<br>AGAGAGAGATCTGGACATCTGCCTGATGAAGCAGACCAACCGGTTCCATCTACAGAGAGGGCTACATCAGATTCGAG<br>AACCTCATGTACCAGGGCGAACACCTGGCCGGATATGCCGGCGAAAGAGTGGTGCTGAGATACGACCCCAGAGAC<br>ATCACCTCTGTGCTGGTGTACCAGCCTCAGAAAGACAAAGAGGTGTTCCTGGCCAGAGCCTACGCCACAGGACTGG<br>AAGCTGAACAGGTGTCCCTCGAGGAAGTGAAGGCCAGCAACCAGAAGATCAGAGAGAAGGGCAAGACCATCAGCA<br>ACCACAGCATCCTGGAAGAAGTCCGCGACCGGGATATCTTCGTGGCCAAGAAAAAGACCAAGAAAGAGCGCCAGA<br>AAGAGGAACAGAAGCAGCTGCACAGCGCCGTGTCCAAGTCTCAGCCTGTGGAAGTGGAACCCGAGCCTGAGATCG<br>AGGATACCCCTGTGCCTAAGAAAAAGCCCCGGGTGCTGAACTACGATCAGCTGAAAGAGGACTACGGCTGGTAA |
| | TnsC (SEQ ID NO: 1100) | ATGGCCGAGAACAAGGCCCAGTCTGTGGCTGAGCAGCTGGGCGAGATCAAGAGCCTGGATGCCAAACTGCAGGCC<br>GAGATCGAGAGACTGAGAGGCAAGACCCTGCTGGAACTGGAACAGGTGTCCAAGCTGCACGACTGGCTGGAAGGC<br>AAGCCGGAGAAGCAGACAGGCTGTAGAGTCGTGGGCGAGAGCAGAACCGTGGCCTGCGACAGCTAC<br>AGACTGACACACAGACCCATCCAAGAAGTGGGCAAGCCTCCTATCGTGCCCGTGGTGTATATCCAGCCTCCTCAAG<br>AGTGTAGCAGCGGCGAGCTGTTCAGAGTGATCATCGAGCACCTGAAGTACAACATGGTCAAGGGCACCGTGGGCGA<br>AATCCGCAGCAGAACACTGCAGGTCCTGAAGAGATGCGGCGTGGAAATGCTGATCATTGACGAGGCCGACCGGCTG<br>AAGCCTAAGACCTTTGCTGACGTGCGGGACATCTTCGACAACCTGGGCATCTCTGTGGTGCTCGTGGGCACCGATAG<br>ACTGGACACCGTGATCAAGCGGGACAGGCAGGTCTACACCAGCCGGTTCAGAGCCAGCTACCACTTCGGCCAGCTGAAG<br>GGCAACAAGTTCAAAGAGACAGTCGAGATCTGGGAGCAAGACGTGCTGAGACTGCCCGTGCCTAGCAACCTGGGA<br>AGCAAGCCCATGCTGAAGATCCTGGGAGAAGCCACCGGCGGCTATATCGGCCTGATGGACATGATCCTGAGAGAGG<br>CCGGAATCAGAGCCCTCGAGCAGGGCCTGACCAAGATCGACAGAGACACCCTGAAAGAGGTGGCCCAAGAGTACA<br>AGTGA |
| | TniQ (SEQ ID NO: 1101) | ATGGACGAGATCCAGCCTTGGCTGTTCGCTATCGCTCCTCTGGAAGGCGAGAGCCTGTCTCACTTCCTGGGCAGATT<br>CAGAAGAGAACGACCTGAGCGCCTCCATGCTGGGAAAAGAGGCCGGAATTGGAGCCGTGGTGGCCAGATGGGA<br>GAAGTTCCACCTGAATCCATTTCCAAGCCGGAAAGAGCTGGAAGCCCTGGCCAAAGTGGTGCAGGTCGACAGCGAT<br>CGGCTGAGAGAAATGCTGCCTCCTGAAGGCGTGGGCATGAAGCACGAGCCTATCGACTGTGCGGCAGCTGCTATG<br>CCCCAGTCTCCTTGCCACAAGATCGAGTGGCAGTTCAAGACCACACAGAGATGCGACCGGCACAAGCTGACACTGCT<br>GAGCGAGTGCCCTAACTGCAAGGCCAGATTCAAGATCCCCGCTCTGTGGGCCGATGGCTGGTGCCACAGATGCTTT<br>ACCACCTTCGCCGAGATGAGCAAGAGCCACAAAGAACTCGTGTGA |

TABLE 27-continued

| Name/<br>Organism/<br>System<br>ID (T) | | Sequences |
|---|---|---|
| | Cas12k<br>(SEQ ID<br>NO: 1102) | ATGAGCCAGATCACCGTGCAGTGTAGACTGGTGGCCAGCGAGAGCACAAGACACCCACCTGTGGAAGCTGATGGCCG<br>ACCTGAACACCCCTCTGATCAATGAGCTGCTGGCCAGAATGGCCCAGCACCAGGATTTTGAGACATGGCGGAAGAA<br>GGGCAAGCTGCCCGACGGAATTGTGAAGCAGCTGTACCAGCCTCTGAAAACAGACCCCAGATTCACCAACCAGCCT<br>GGCCCGGTTTTACACCAGCGCCATCACCGTGGTGGACTACATCTACAAGAGCTGGTTCAAGATCCAGCAGCGGCTGG<br>AACAGAAGCTGAAGGGCCAGATCAGATGGCTGGGCATGCTGAAGTCCGACGAAGAACTGGCCGCCGAGAGCAACA<br>CCAGCATCGAAGTGATCAGGACCAACGCCGCCGAGCTGATCACAAGCCTGTCTAGCGAGGATGGCAGCGTGTCCAC<br>CAGACTGTGGAAAACCTACGACGAGACAGACGACATCCTGACACACTGCGTGATCTGCTACCTGCTGAAGAACGGC<br>AGCAAGGTGCCCAAGAAGCCCGAGGGAAACCTGGAAAAGTTCGCCAAGCGGCGGAGAAAGGTGGAAATCAAGATC<br>GAGCGGCTGCGGCGGCAGCTGGAAAGCAGAATTCCTAAGGGCAGAGATCTGACCGGCAAGAATTGGCTGGAAACC<br>CTGGCCATTGCCAGCACAACAGCCCCTGCCGATGAACCTGAAGCTCAGTCCTGGCAGGATACCCTGCTGACCGAGT<br>CTAAGCTGGTGCCCTTTCCAGTGGCCTACGAGACAAACGAGAATCTGACCTGGTCCAAGAACGAGAAGGGCAGACT<br>GTGCGTGCAGATCCAGCGGCCTGAGCAAGCACATCTTCCAGATCTACTGCGACCAGAGACAGCTGAAGTGGTTCCAG<br>CGGTTCTACGAGGACCAAGAGATCAAGAAGGCCAACAAGGACCAGTACAGCTCCGGCCTGTTCACCCTGAGATCTG<br>GCAGAATCGCCTGGCAAGAGGGCACCGATAAGGGCGAGCCTTGGAACATCCACCACCTGATCCTGTACTGCACCGT<br>GGACACAAGGCTGTGGACAGCCGAGGGAACAGAGCAAGTGTGCCAAGAGAAGGCCGAAGATATCGCCAAGACACT<br>GACCCGGATGAAGAAGACAAAGGCGATCTGAACGACGGCAGCAGGCCTTCATTCGGAGACAGCAGAGCACACTGGC<br>CCGGCTGAACAACCCCTATCCTAGACCTAGCCAGCCACTGTACCAGGGCCAGCCTCACATTCTTGTCGGCCTGGCCT<br>TTGGCCTGGACAAACCTGCTACAGCCGCCGTGGTTGATGGCACAACAGGCAAGGCCATCACCTACCGCAGCCTGAA<br>ACAGCTGCTGGGCGACAACTACGAGCTGCTGAACAAGCAGCGGAAGCGGAAGCAGCAGCAGTCTCACCAGAGGCA<br>CAAGGCCCAGAGCAACGGCAGAAGCAACCAGTTCGGCGTAGCGACCTGGGCGAGTACGTTGACAGACTGCTGGC<br>TAAGGCCCTCGTGACACTGGCTCAGTCTTATCAGGCCGGCTCCATCGTGCTGCCTAAGCTGGGAGATATCAGAGAGC<br>TGATCCAGAGCGAGATTCAGGCCAAGGCCGAGCAGAAGATCCCCGGCTATATTGCCGGACAAGAGAAGTACGCCA<br>AGCAGTACAAGATCTCCGTGCACCAGTGGTCTTACGGCCGGCTGATCGACAACATTAAGGCCCAGGCCGCCAAAAT<br>CAGCATCGTGATCGAGGAAGGACAGCAGCCCATCAGAGGCAGCCCTCAAGAGAAAGCCAAAGAGATGGCCATTAG<br>CGCCTACGATGACCGGACCAAGTCCTGA |
| | TracrRNA<br>(SEQ ID<br>NO: 1103) | AACTAATCTAAATTCTGTACCTTGACAATAGAATAGAATTATCAATAGCGCCACAGGTCATGTTCAATAGAACCTCT<br>GAACTGTGAAAAGTGTGGGTTAGTTTAACTGTCGGCAGACAGTTGTGCTTTCTGACCCTAGTAGCTGTCCACTCGGA<br>TGCTGATATCTACGGTTTCGGCTGTAGGAATGATTAACCTGTAAGTTGAAGTACACTGATACTTCAATTTTATGGGG<br>TAGGTGCGCTCCCAGCAATAAGAGTGTGGGTTTACTACAGTGATGGCTACTGAATCACCTCCGAGCAAGGGGGAAT<br>CCACCCTAATTTTTCTTTTTCGTGAACCCAAGCGGGGTCAAAATTCCTGGGAGGTTTACGAAAACTGTAAATCCCTT<br>ATCAAATATTGAGTTCAGTATTTTTGTGGGATGGTTGCCTCTGTAAATACAGGAGATAGAAAGCGAAAATTTTAGAG<br>GTTTACGAAAATCGCCTCTAAAAGCTCCTCCAGGTAACTGTTGTAGCGATCGCT |
| | DR<br>(SEQ ID<br>NO: 1104) | GTTTCAACTACCATCCCAACTAGGGGTGGGTTGAAAG |
| | sgRNA<br>(SEQ ID<br>NO: 1105) | AACTAATCTAAATTCTGTACCTTGACAATAGAATAGAATTATCAATAGCGCCACAGGTCATGTTCAATAGAACCTCT<br>GAACTGTGAAAAGTGTGGGTTAGTTTAACTGTCGGCAGACAGTTGTGCTTTCTGACCCTAGTAGCTGTCCACTCGGA<br>TGCTGATATCTACGGTTTCGGCTGTAGGAATGATTAACCTGTAAGTTGAAGTACACTGATACTTCAATTTTATGGGG<br>TAGGTGCGCTCCCAGCAATAAGAGTGTGGGTTTACTACAGTGATGGCTACTGAATCACCTCCGAGCAAGGGGGAAT<br>CCACCCTAATTTTTCTTTTTCGTGAACCCAAGCGGGGTCAAAATTCCTGGGAGGTTTACGAAAACTGTAAATCCCTT<br>ATCAAATATTGAGTTCAGTATTTTTGTGGGATGGTTGCCTCTGTAAATACAGGAGATAGAAAGCGAAAATTTTAGAG<br>GTTTACGAAAATCGCCTCTAAAAGCTCCTCCAGGTAACTGTTGTAGCGATCGCTGAAATCCCAACTAGGGGTGGGTT<br>GAAAAGNNNNNNNNNNNNNNNNNNNNNNNN |
| | LE<br>(SEQ ID<br>NO: 1106) | CCGTACTGAGTCTATTCGTTGACTCGAGAGGATCTAAACGAGATCAATTTTTCACAAAGACACATAATTTGACTCCA<br>CAACAAATAATGTGTCAGTGTACATGTCGATTGCCAAAATTATATGTCGTCTTGTCAAATTAATTGACATGATAAATT<br>TTAAGCCTGTAATCCTCACGAATCATAGATTACAGGCTATTTTAGCATCTTTCACTTCATTGAATACTAATTGACAAA<br>TTAAATGTCCTTATCTTGGGAAATTGACAAATTAAATGTCCAAGTTTGGAAATTAAGATTTTTATCATCTTTGACAGAT<br>TGTTTGTCATTACCAGTATAATTGTACTATGTTGCAATTAAACAGTAATGTTGGAATATGGCGACAGATAACCCTAA<br>TGCCTCTGGAATTGTGACCGAACTCTCGCATGAGGCGAAACTGAAGCTAGAAATTATTGAGAGTTTGCTGGAACCGT<br>GCGATCGCCAAACCTACGGGGAACGTCTCAAAGATG |
| | RE<br>(SEQ ID<br>NO: 1107) | TAGATGCCCAGTCGCCATTTAATTTGAAGCCTGGGTTTCAACTACCATCCCAACTAGGGGTGGGTTGAAAGTTACCT<br>TTAGGCAAGCAAATTTTTCTAAAGCGATCAGTTAGACACTCTGAAAAATTACAAATGATAGGATGGATTGAAAGGA<br>GCATCGGACTCTTAACTTTGTATGTAAGATTGCAGCTAATTGTCCAATGGCTGTTAGAAAGGACGCTTAATTTGTC<br>ACTGTTATTTAAAAGACACTAATTTGTCAAAACGACATTAATTTGACAACGACGACAAATAATGTGGCAATCGACA<br>ACAAGATGGGTAACCAGGGGCTCGAACCCTGAACCAACGGATTAAGAGTCCGATGCTCTACCATTGAGCTAGTCAC<br>CCTTAGAAAAACTATTATAACAGATTTTAATAAATTAAGTAAACTATTTACTAAAAATTTTTGATTAACCGATCGCT<br>AATTTATTCGGGATACTATACATATCATGCTCCCGATTTGC |
| CP003630/<br>Microcoleus<br>sp.<br>PCC 7113/<br>T49 | TnsB<br>(SEQ ID<br>NO: 1108) | ATGAGCCAGGACAGCCAGAGATTCTTCAGCCCTCACGAGGGCAACAAGCCCACCGAGCTGCAGAGAACCAGCAAG<br>AACCCTGCCAAGAGCCACAGACTGCCTAGCGACGAGCTGATCACCGATGAAGTGCGGCTGCGGATGGAAATCATCC<br>AGAGACTGACCGAGCCTTGCGACAGAAAGACCTACGGCATCCGGAAGAGAGAGGCCGCCGAAAAGCTGGGAGTGA<br>CCCTGAGATCCATCGAGCGGCTGCTGAAGAAGTACCAAGAGCAGGGACTCGTGCTGGGCCTGACACAGACCGATCTGA<br>CAAGGGCCAGAAGAATCAGCGCCGACTGGCAAGAGTTCATCGTCAAGACCTACAAAGAGGGAACAAGGGCAG<br>CAAGCGGATGCTGCGGAACCAGGTGTTCCTGAGAGTGAAGGGCAGAGCCAAGCAGCTGGGCCTGAAGCCTGAGGA<br>ATACCCTAGCCACCAGACCGTGTACCGGATCCTGGACGAGTACATCGAGGGCAAAGAGCGGAAGCGGAACGCCAG<br>ATCTCCTGGCTATCTGGGCAGCAGACTGACCCACATGACCAGATGCCTGATGGCTTCTTCCTGGGCTTTTTCGCCCCTAGCAGCCAGATC<br>GATGCCCTGGCTCTGAGACACGCCATCCTGCCTAAGTTCTACGGCAGCGAGTATGGCCTGGGCGACAAAGAGTTTG<br>GCACCTACAGATCCCAGCTACTTCTACACCGACGGCGGCAACGACTTCCAGGACCGCGGAATTGTGGAACGGTTCTTCAAG<br>ACCCTGAACGACCAGGTGCTGAGAAACCTGCCTGGCTACACCGGCTCCAATGTGCAAGAAAGACCCGACGACGTGG<br>ACAAGGACGCCTGTCTGACACTGAAGGACCTGGATATCATCCTCGTGCGGTACATGGTCAAAGAGTACAACGGCCA<br>CACCGACGCCAGATTCATCGTGAAAGAGTATAACGCCGACGACACCGACGTGAAGCTGAACGCCCAGACACGGTTC<br>ATGAGATGGGAGGCCGGACTGATGATCGAGCCTCCTCTGTACGATGAGCTGGACCTCGTGATCGCCCTGATGAAGG |

TABLE 27-continued

| Name/<br>Organism/<br>System<br>ID (T) | Sequences |
|---|---|
| | CCGAGAGAAGGACCGTGGGCAAATACGGCACCCTGCAGTTTGAGAGCCTGACCTACAGAGCCGAGCACCTGAGAG<br>GCAGAGAAGGCAAAGTGGTGGCCCTGAGATACGACCCCGACGACATCACCACCATCTTCGTGTATCAGATCCACGA<br>GGACGGCACCGAGGAATTTCTGGACTACGCCCATGCTCAGGGCCTCAGGGTGGAAAGACTGAGCCTGAGAGAGCTG<br>CAGGCCATCAAGAAGCGGCTGAGAGAAGCCCGGGAAGAGATCAACAGCGAGACAATCCAGGCCATGCTGGAACGG<br>GAAGAGTGGACCGAGGAAACCATCAAGCGGAACCGGCAGCAGCGGAGAAAAGCCGCTCACGAGCTGGTCAATCCT<br>GTGCAGAGCGTGGCCGAGAAGTTCGGCATCGTGGAACCTCAAGAGGCCGACTCTGAGGCCGAGGAAGAACTGGAA<br>GCCGAGCTGCCTAGATACAAGGTGCAGTACATGGACGAGCTGTTCGACGACGACTGA |
| TnsC<br>(SEQ ID<br>NO: 1109) | ATGCCCTACCACATCTGGATGTACGAGCTGCTGCTGAGCAGAATGACCGGCCTGCTGCTGGGCGAGTCTAGATCTGG<br>CAAGACCGTGACCTGCAAGACCTTCACCAACCGGTGCAACCAGCAGGCCAAGACCAAGGACAAGCGCGTGATGCC<br>CGTGATCTACATTCAGATCCCCAAGAACTGCGGCAGCCGGGACCTGTTCATCAAGATCCTGAAAGCCCTGGGCCAC<br>AGAGCCACCAGCGGCACAATTACCGACCTGAGAGAGAACCCTGGACACCCTGGAACTGTTTCAGGTGCAGATGC<br>TGATCATCGACGAGGCCAACCACCTGAAGCTGGAAACCTTTAGCGACGTGCGGCACATCTACGACGACGACAATCT<br>GGGCCTGAGCGTGCTGCTCGTGGGCACCACAAATAGACTGACCAGAGTGGTGGAACGGGACGAACAGGTGGAAAA<br>CCGGTTCCTGGAAAGATACCAGCTGGACAAGATCAACGACAAAGAGTTCCAGCAGCTGGCCAAAATCTGGGTGCAA<br>GACGTGCTGGGCATGAGCGAGGCCAGCAATCTGATCAAGGGCGAGACACTGCGGCTGCTGAAGAAAACCACCAAG<br>CGGCTGATCGGCCGGCTGGACATGATTCTGAGAAAGGCCGCCATCAGAAGCCTGCTGAAGGGCTACGAAACCCTGG<br>ATGCCGAGGTGCTGAAACAGGTGGCCAAGAGCGTGAAGTGA |
| TniQ<br>(SEQ ID<br>NO: 1110) | ATGGACGAGCTGGAAACCCAGCTGTGGCTGAACAGAGTGGAACCCTACGAGGGCGAGAGCATCAGCCACTTTCTGG<br>GCAGATTTCGGAGAGCCAAGGGCAACAAGTTCAGCGCCCCTTCTGGCCTGGGAAAAGTGGCAGGACTGGGCGTCGT<br>GCTCGTCAGATGGGAGAAGCTGTACCTGAATCCATTTCCAACCAGGCAGCAGCTGGAAGCCCTGGCCGATGTGGTT<br>ATGGTGGACGCCGATAGACTGGCCCAGATGCTGCCTCCTAAGGGCGTGACCATGAAGCCCAGACCTATCCTGCTGT<br>GCGCCGTGTGCTATGCCGAGAATCCCTACCACAGAATCGAGTGGCAGTTCAAAGAGAGATGGGGCTGCGACGGCAG<br>AAGCGCCAATAGACTGAGACACAGACACCAGCTGCCTCTGCTGGGCAAGTGCATCAACTGCGAGACACCCTTTCCT<br>ATACCTGCTCTGTGGGTGGAAGGCGAGTGCCCTCACTGCTTTCTGCCCTTTGCCAGAATGGCCAAGCGGCAGAAGTC<br>CAGAAGGGCCTAA |
| Cas12k<br>(SEQ ID<br>NO: 1111) | ATGAGCATCATCACCGTGCAGTGCCAGCTGAAGGCCACCAAGGATAGCCTGAGACACCTGTGGTCCCTGATGGTGG<br>AAAAGAACACCCTGCTGGTCAACGAGCTGCTGAAGCAGATCAACACACACCCCGACCTGGAAAACTGGCTGAAAGT<br>GGGCAACATCAAGGCCGAAGTGATCGAGGGCCTGTGCGACAACCTGAGAACCGAGAGCAGATTCCAGGACATGCC<br>CGGCAGATTTGCCAACGCCGCCGAGAAGTGGTCAAGGACATCTACAAGAGTTGGTTCGCCCTGCAAGAGGAACGG<br>CGGTTTAGACTGTGGCGGAAGCAGAGATGGTTCAGCCTGCTGCGGAGCGATCTGGAACTGGAACAAGAGAGCGCC<br>TGAGCCTGGAAAAGCTGAGAACAGAGGCCACAAAGATCCTGATCAAGGCCCAGCTGGAATGCAGCAGAGAGGCCG<br>AACCAGATCAGGCCACCACCGATAATAGCAGCGCCCTGTGGGACAATCTGTTCACCGCCTACGACAAGTTCAAGAG<br>CCCCAGACTGAGATGCGTGATCGCCTACCTGCTGAAGAACGGCTGCCAAGTGAACAAGGTGGAAGAGGACCCTGAG<br>GCCTACCAGCGGCGCAGAAGAAAGAAAGAGATCCAGATGAGCAGCTGAAAGAGCAGCTGAAGTCCAGACTGCCC<br>AAGGGCAGAAACCTGAGCGAGCAAGAATGGCTGGAAGCCCTGGAACAGGCCCAGGGACTGATCATCGACGACGAG<br>CATCTGAGACAGGTGCAGGCCAGCCTGACCAGAAAGCAGAGCCCAGTGCCTTTCAGCATCAGCTACGAGACAAGCA<br>CCGACCTGCGGTGGTCCAGCAATGAGCAGGGCAGAATCTGCGTGTCCTTCAACGGCAAGGGCATCAGCAAGCACAC<br>CTTCGAGGTGTTCTGCGACCAGCGGCAGCTGCATTGGTTCGAGAGATTCTACGAGGACTACAAGATCTTCACCCAGA<br>ACAAGGACCAGGTGCCAGCCGGACTGCTGACACTGAGATCTGCCGACTCGTGTGGCAAGAAGGCGAAGGCGAGG<br>GCGAGCCTTGGCAAGTTCATAGACTGCTGCTGCACTGCAGCGTGAAACCAGACTGTGGACAGCCCAGGGCACAGA<br>AGAAGTGCGGGCCGAGAAAATCGCCCAGACACAGGCCGCCATCGACAGACAGAAAGCCAAGGGCACCCAGAGCAA<br>GAAGCTGAACACAAGCCTGGAACGGCTGAAAACCTTTCAGGGCTTCTCCCGGCCTAGCCGGGCCAGCTATAAGGGC<br>AATTGCAGCATCGTGATCGGAGTGTCCTTCGGCAGAGCCAAGCCTGCCACAGTGGCCGTGGTCAATGTGGAAACAG<br>GCGAGGTGCTGGCCTACCGGGATGTGAAACAGCTGCTCAACAAGCCCATCAAAGAGGCAAGACCAAGAGGAAGA<br>AAACCCAGTACGAGTACCTGAAGCGGAACAAGCAGCGCCTGAACAGCCACCAGAGACACAACGCCCAGA<br>AGAATGGCGCCCCTTGCAATTTCGGCGAGAGCAAGCAGGGCGAGTACGTGGACAGACTGCTGGCCAAGGCCATTGT<br>GGAAGTGGCCAGCCAGTACAGAGCCAGCTCTATCGTGCTGCCCGACCTGAGGAATATCGAGGAAGCCGCCGAAAGC<br>GAAGTTCGGGCCAGAGCCGAGCAGAAGTTCCCCGGAAATCAGAAGCTGCAGGACAGCTACGCCAAGGACTACAGG<br>GCCAGCATCCACTGCTGGTCCTACTCTAGACTGGCCCAGTGCATCGAGCTGAAAGCCGGAAAGGCCGGAATCGCCA<br>CCGAGAAAGTGCATCAGCCTCACGGCGATACCCCTCAAGAGAAGGCCAGAGATCTGGTGCTGGCTGCCTACGCCAA<br>CAGAAAGGGTGTCCGTGTCCTGA |
| TracrRNA<br>(SEQ ID<br>NO: 1112) | GTAAACCTTTCCTGAACCTTGACAATATAAATAAACAATGTTAATTAGTTAACAGCGCCGCTCGTACATGCTTATTG<br>CCTCTGTACAGTGCTAAGTTAGGGTCTGTTTGACTGTCCGGAAGGCAGTTTTACTTTCTGAGCCCTGGTAGCTACCCG<br>CCCGTAATGCTGCCCCGATGACACCTTCTTCATCGGTGGGACAATTCCCGTATCTGAATACCGAAGTATAGAGTATA<br>TGGGAGGTGCGCTCCCAGCTTTCGTGGTCGGGCTGAGGGAGGAGGTAAATTTTCCCAAAGCCTTAGCCCTTGTTAAC<br>AAGGGTGTGGATTACCACAGTGGTGGCTCCGAACTCGTCCCCTTCGGGGGAGCCCTCCCTAATATTTTTTTGACGGC<br>TGAAAGCGGGGTCAAAATCCCTGAGTAGCCGTCAGTAGTTCAAAACTCTTGTCCAGTCTTGGTTTTAGGCTTTCACG<br>TCAGTCAACTTTCTTCTTGGGAAAGAGCTGAAATGAGCAATTTAAAATCAGCCGTCAAAAATATATTTGTCAGGTTG<br>TGTAGACAAGGGTTTCAGCGGGCGCG |
| DR<br>(SEQ ID<br>NO: 1113) | GTTTCATCACCCCTCCCGCCTTGGGATGGGTTGAAAG |
| sgRNA<br>(SEQ ID<br>NO: 1114) | GTAAACCTTTCCTGAACCTTGACAATATAAATAAACAATGTTAATTAGTTAACAGCGCCGCTCGTACATGCTTATTG<br>CCTCTGTACAGTGCTAAGTTAGGGTCTGTTTGACTGTCCGGAAGGCAGTTTTACTTTCTGAGCCCTGGTAGCTACCCG<br>CCCGTAATGCTGCCCCGATGACACCTTCTTCATCGGTGGGACAATTCCCGTATCTGAATACCGAAGTATAGAGTATA<br>TGGGAGGTGCGCTCCCAGCTTTCGTGGTCGGGCTGAGGGAGGAGGTAAATTTTCCCAAAGCCTTAGCCCTTGTTAAC<br>AAGGGTGTGGATTACCACAGTGGTGGCTCCGAACTCGTCCCCTTCGGGGGAGCCCTCCCTAATATTTTTTTGACGGC<br>TGAAAGCGGGGTCAAAATCCCTGAGTAGCCGTCAGTAGTTCAAAACTCTTGTCCAGTCTTGGTTTTAGGCTTTCACG<br>TCAGTCAACTTTCTTCTTGGGAAAGAGCTGAAATGAGCAATTTAAAATCAGCCGTCAAAAATATATTTGTCAGGTTG<br>TGTAGACAAGGGTTTCAGCGGGCGCGGAAATCCCGCCTTGGGATGGGTTGAAAGNNNNNNNNNNNNNNNNNNNNN<br>NNN |

TABLE 27-continued

| Name/<br>Organism/<br>System<br>ID (T) | | Sequences |
|---|---|---|
| | LE<br>(SEQ ID<br>NO: 1115) | TACTATACAAATACGTTAAGGTATTAATCTCCCAAAAGACACACTATAAAAAAGACTTCTCAGCGACTGAACGCTA<br>GAAGCCTTCCGTTGATTTATTCTTGTACATTCACAAATTAAATGTCGTTATTTAACAAATTAATGTCGTAGAAAGATT<br>AGCGCGTAATCTACATTCTACAAGGGTTTCAGTGACTTTCAATCTTAACTAAGGTGAACGTCCGCATTTAACATTTTA<br>TACGTCGCAATTTAGTACCTTTAACAATTTTATATGTCGGTTATTGGCTAAAACTTCAATTTGAATCTTAACTAGACTT<br>CACAAATTGTTTGTCGCATTTTAGGGCAAGCCAGACTATCATTTGGACAGCGGTTAGTACATTGGTTCTGTTTGTTGC<br>TTACTGCTCACTCTATTATGTGGAACTCTCGCATCACGTATGTAGGTGAAGAATGTCTCAGGATTCACAACGTTTTTT<br>TTCTCCGCATGAAGGTAATAAGCCAACTGAACTT |
| | RE<br>(SEQ ID<br>NO: 1116) | TTCATCACCCCTCCCGCCTTGGGATGGGTTGAAAGTCTGTGTTACCTTATTTCCTGGAATTTGTAGGGAAGGTTGAAA<br>GGCGCACTTCGTTCGGGATTATTCTGATAGGATTAAATATTCTCAACACAATGAGAGGGTAACTTTCTTACTTCATTT<br>TCCACGTTCAGAAGTTTAGCGACAATAATTTGTTAACAGTTGCCTAGAAGCAAAGTCGCCGTAACAGCGACGTGAA<br>TTTGTTAAAAACGACATCAATCTGTTAATAGCGACATTTAATTTGTGAATGTACAACAATTATAATCGGGATGACAG<br>GATTTGAACCTGCGACCCCTTCGTCCCGAACGAAGTGCGCTACCAAGCTGCGCTACATCCCGATAAGTTATAGCCGT<br>AACTCATCTATGGTATCACATTGTATCGGCAATCAGCCGCCAGCTTGCTAGGATAATCACTGTAACTTCAGTGGGAG<br>CTGGGCTGGGAGTGGTCGTTAAACCAGAATGGTTGCG |
| CP003659/<br>Anabaena<br>cylindrica<br>PCC 7122/<br>T50 | TnsB<br>(SEQ ID<br>NO: 1117) | ATGTACATGCGGAACGAGACACCCCTGACACCTGGCAACCTGGGAGATGAGAGCAGCATCGGCAAAGAAACCCAG<br>GTGCTGGTGTCTGAGCTGAGCGGAGAGGCCAAGCTGAAGATGGAAGTGATCCAGAGCCTGCTGGAAGCCGGCGAC<br>AGAACAACATACGCCCAGAGACTGAAAGAGGCCGCCGTCAAGCTGGGAAAGTCTGTGCGGACAGTGCGGCGGCTG<br>ATCGACAAGTGGGAAGAAGAGGGACTCGTCGGCCTGACACAGACCGAGAGAGTGGATAAGGGCAAGCACAGAGTG<br>GACGGAGAACAAGGAGGTTCATCCTCAAGACCTACAAGAGGGCAACAAAGGCGCGACGGATGAGCAGACAG<br>CAGGTCGCCGTCAGAGTGAAAGTGCGGGCTGATGATCTGGGCGTGAAGCCTCCTAGCCACATGACCGTGTACCGGA<br>TCCTGGAACCTGTGATCGAGAAGCAAGAGAAGGCCAAGAGCATCAGAAGCCCCGGCTGGCGAGGAAGCAGACTGA<br>GCGTCAAGACCAGAGATGGCAAGGATCTGCAGGTCGAGTACAGCAATCAAGTGTGGCAGTGCGACCACACCAGAG<br>CCGATGTGCTGCTGGTGGATAAGCACGGCGAGATCCTTGGCAGACCTTGGCTGACCACCGTGATCGACAGCTACAG<br>CAGATGCATCGTGGGCATCAACCTGGGCTACGATGCCCCTAGTTCTCAGGTGGTGGCTCTGGCCCTGAGACACGCCA<br>TTCTGCCTAAGCAGTACGGCCAAGAGTACGAGCTGTACGAGGAATGGGGCACCTACGGCAAGCCCGAGCACTTTTA<br>CACAGACGGCGGCAAGGACTTCAGAAGCAACCATCTGCAGCAGATCGGCGTGCAGCTGGGCTTTGCCTGTCACCTG<br>AGAGACAGACCTAGCGAAGGCGGCATCGTGGAAAGACCCTTCAAGACCTTCAACACCCAGCTGTTCAGCACACTGC<br>AGGGCTACACCGGCAGCAACGTGCAAGAAAGACCTGAGGAAGCCGAGAAAGAAGCCTGTCTGACCCTGAGAGAGC<br>TGGAACAGAGACTGGTGGCCTACATCGTGAACACCTACAACAGCGCGAGGACGCCAGAATGGGCGATCAGACCA<br>GATTTCAGAGATGGGACAGCGGCCTGATCGTGGCCCCTGAAGTGATCAGCGAGAGAGATCTGGACATCTGCCTGAT<br>GAAGCAGAGCCGGCGGATGATTCAGAGAGGCGGCTACCTGCAGTTCTGAGAACCTGATGTACAAGGGCGAGCACCT<br>GGCCGGATATGCCGGCGAATCTGTGGTGCTGAGATACGACCCCAGAGACATCACCAATCCTGGTGTACTCCCAC<br>AAGGGCCACAAAGAGGAATTTCTGGCCAGGGCCTACGCTCAGGACCTGGAAACAGAGGAACTGAGCCTGGATGAG<br>GCCAAGGCCATGATCAGACGGATTAGAGAGGCCGGCAAGACCATCAGCAACCGGTCTATGCTGGCCGAAGTGCGG<br>GACAGAGAAACCTTCGTGAAGCAGAAAAAGACCAAGAAAGAGCGGCAGAAAGAGGAACAGGCCGTCGTCCAGAA<br>AACAAAAAAGCCCGTGCTGCCTGTGAACCGTCGTGGAAGAGATCGAGGTGGCCTTCGTTGGAATCCAGCCAAGAAACCGA<br>CATGCCCGAGGTGTTCGACTACGAGCAGATGAGAGAAGATTACGGCTGGTGA |
| | TnsC<br>(SEQ ID<br>NO: 1118) | ATGGAACTGGTCGAGGAAGTGAACAAGATCGTCGGCATCAAGACCAAAGAGACACTGACCCCAGGCCAGGTGGTC<br>AAGGCCATGATCCTGAATGGCCTGGGCTTTCTGAGCGCCCCTCTGTACCTGTTCGGCGAGTTCTTTGTGGGCAAAGC<br>CACCGGACCCTGATCGGAGAAGGCGTGCTGCCCGAACACCTGAACGATGACAAGCTGGGCAGAGAGCTGGACAA<br>GTACCACCAGATCGGCACCACCAAGATCTTCACCGCCGTGGCCATTAAGGCCGCTCACAAGTTCCAGGTGGAAATG<br>GACAGCATTCACCTGGACGGCACCAGCATGTCTGTGGAAGGCGAGTACAAGAAAGAGATCAAAGAGATTGACGAG<br>ATCAAGCAAGAGACAGAGGAAAACAAGCTGGAAATCGAGCCCGAGATGAAGGCCATCGAGATCGTGCACGGCTAC<br>AGCAGACAGAGGCCCGACCTGAAGCAGTTCATCATCGACATGATCGTGACCGGCGACGGCGACATCCCACTGT<br>ATCTGAAAGTGGACAGCGGCAACGTGGACGACAAGAGCGTGTTCGTGGAACGGCTGAAAGAATTCAAGAAGCAGT<br>GGACCTTCGAGGGCATCAGCGTGGCCGATAGCGCTCTGTACACAGCCGAAAATCTGGCCGCCATGCGCGAGCTGAA<br>GTGGATCACAAGAGTGCCCCTGAGCATCAAAGAGGCCAAGAACAAGATTGTGGATATCAAAGAAGCCGAGTGGAA<br>GGACAGCCAGATCCGACGGCTATAAGATCGCCGCCAAAGAGACCAAGATCAAGGGCCAGACCAGCGGTGGATCAT<br>CGTGGAAAGCGAGATCCGGAAGAAGTCCAGCATCCAGCAGGTCGAGAAGCAAGTGAAGAAGCAAGAAGCCAAGG<br>CCAAGGCTGCCCTGAGCAAGCTGAGCAGACAAGAGTTCGCCTGCCAGCCTGACGCCAAGATCGTGATCGAGAAGCT<br>GTCCAAGTCCTGGAAATATCACCAAATCAAAGAAATCGAGTACATTGAGAAGCTCGAGTATAAGACCGCCGGCAGA<br>CCCTCCAAGCTGACAGAGCCTAGCCAGATTAAGTACCAGATCAAGGGCCAGACCAGACACGGGAAGAAGTGATC<br>GAAACCGAGAAGATCAATGCCGGCAGATTCATCCTGGCCACCAACGTGCTGGACCGGAATGAGCTGTCCGACGAGA<br>AGGTGCTGGAAGAGTACAAGGCCCAGCAGAGCAACGAGCGGGGCTTCAGATTCCTGAAGGACCCTCTGTTCTTCAC<br>CAGCTCCGTGTTTGTGAAAACCCTGAGAGAGTGGAAGCCATTGCCATGATTATGGGCCTGTGCCTGCTGGTGTACA<br>ATCTGGCCCAGCGGAAGCTGAGACAAGAACTGGCCAAGTTCGACGACGGCATCCGCAATCAAGTCAAGAAGATCA<br>CCAACAAGCCCACCATGAGATGGGTGTTCCAGATGTTCCAGGCCGTGCACCTGGTCATCATCAACGGCCAGAAACA<br>GATGAGCAACCCGTGACCGAGGAACGCGAGAAGATTGTGCGCTACCTGGGCAAGTCCTGCAGCAAGTACTACCTGATC<br>ACCTGA |
| | TniQ<br>(SEQ ID<br>NO: 1119) | ATGGAAGTGGGCGAGATCAACCCATGGCTGTTCCAGGTGGAACCCTACCTGGGCGAGAGCCTGTCTCACTTCCTGG<br>GCAGATTCAGACGGGCCAACGATCTGACCACAACCGGCCTGGGAAACGCTGCTGGTGTTGGCGGAGCCATCAGCAG<br>ATGGGAGAAGTTCCGGTTCAACCCTCCACCTAGCCGGCAGCAACTGGAAGCCCTGGCCAAAGTCGTGGGAGTCGAT<br>GCCGATAGACTGGAACAGATGCTGCCTCCTGCTGGCTGGGCATGAACCTGGAACCTATCGATGTGCGCCGCCT<br>GCTACGTGGAAAGCCCTTGTCACAGAATCGAGTGGCAGTTCAAAGTGACCCAGGGCTGCCAGCACCACCACCTGTC<br>TCTGCTGAGCGAGTGCCCTAATTGCGGCGCCAGATTCAAGGTGCCAGCTCTGTGGGTTGACGGCTGGTGCCAGAGAT<br>GCTTCCTGCCTTTCGGCGAGATGATCGAGCACCAGAAGCGGATCTGA |
| | Cas12k<br>(SEQ ID<br>NO: 1120) | ATGAGCCAGATCACCATCCAGTGCAGACTGGTGGCCAGCGAGCAACCAGACAGCAGCTGTGGCAGCTGATGGCCG<br>AGAAGAACACCCCTCTGATCAACGAGCTGCTCAGCCAGATCGGCAAGCACCCCGAGTTCGAGACTTGGAGACAGAA<br>GGGAAAGCACCCCACCGGCATCGTGAAAGAGCTGTGCAGGCCCATCGAAAACCGAGATTCATCGCCAAGT<br>GCCAGATTCTACACCAGCGCTACCGCCAGCGTGAACTACATCTACGAGAGTTGGTTCGCCCTGATGAAGAGATACC<br>AGAGCCAGCTGGACGGCAAGCTGCCGGTGGCTGGAAATGTTCAATAGCGACGCCGAGCTGGTGAACACTCTGGCGT<br>TAGCCTGGATACCCTGAGAGCCACCTCTGCCGAAATTCTGGCCGACCCAGTTCGCCCCTCAAGACACCAACAGAGACACC<br>AGCAACAAGGGCAAGAAAAGCAAGATGGGCAAGAAGTCCCAGAAGTCCGACAGCGAGGGCAACCTGAGCAAGAA<br>GCTGTTCGACGCCTACAGCAGCGCCGAGGACAATCTGACCAGATGCGCCATCAGCCATCTGCTGAAGAACGGCTGC TABLE 27-continued

| Name/<br>Organism/<br>System<br>ID (T) | | Sequences |
|---|---|---|
| | | AAGGTGTCCAACAAAGAGGAAAACAGCGAGAAGTTCACCCAGCGGCGGAGAAAGCTGGAAATCCAGATCCAGCGG<br>CTGACCGAGAAGCTGGCCGCCAGAATTCCTAAGGGCAGAGATCTGACCGACACACAGTGGCTCGAAACCCTGTTCA<br>CCGCCACCTACAACGTGCCCGAGGATGAGACAGAGGCCAAACTGTGGCAGAACAGCCTGCTGCGGAAGTTCAGCA<br>GCCTGCCTTTTCCAGTGGCCTACGAGACAAACGAGGACCTCGTGTGGTCCAAGAACAGATTCGGCAGGATCTGCCT<br>GACATTCCCCACACTGAGAGAGCACATCTTCCAGATCTACTGCGACAGCCGGCAGCTGCACTGGTTCAGAGATTTC<br>TCGAGGACCAAGAGATCAAGAAGAACAGCAAGAATCAGCACTCTAGCGCCCTGTTTACCCTGCGGAGCGGAAGAA<br>TCGCTTGGCAAGAAGGCGAAGGCAAGGGCGAGCCTTGGGACATTCACCACCTGACACTGTACTGCTGCGTGGACAC<br>CAGACTGTGGACCGAAGAGGGCACCAACCTGGTCAAAGAAGAGAAGGCCGAGGAAATCGCCAAGACCATCACACA<br>GACCAAGGCCAAAGGCGACCTGAACGACAAACAGCAGGCCCACCTGAAGAGAAAGAACAGCTCCCTGGCCAGAAT<br>CAACAACCCATTTCCTAGACCTAGCCAGCCTCTGTACAAGGGCCAGAGCCATATCCTGCTGGGAGTGTCTCTGGGAC<br>TCGAGAAGCCTGCTACAGTGGCCGTGGTGGATGGCACAACAGGCAAGGTGCTGACCTACCGGAACATCAAACAGCT<br>GCTCGGCGACAACTACAAGCTGCTGAATCGGCAGCGGCAGCAGAAGCACTTGCTGAGCCACCAGAGACATATCGCC<br>CAGAGAATCGCCGCTCCTAACAACTTCGGCGATAGCGAGCTGGGCGAGTACATCGATAGACTGCTGGCCAAAGAGA<br>TCATTGCCATTGCTCAGACCTACCAGGCCGGCTCCATCGTGCTGCCTAACCTGGGAGACATGCGCGAGCAGATCCAG<br>AGCGAGATTAAGGCCAAGGCCGAGCAGAAGTCTGACCTGGTCGAGGTGCAGAAGAAGTACGCCAAGCAGTACCCC<br>AACAGCGTGCACCAGTGGTCTTACGGACTGATCACCAACATCCAGTCTCAGAGCAAGAAAGCCGGGATCGTGA<br>TCGAGGAAGGCAAGCAGCAGATCCGGGCCAGTCCTCTGGAAAAAGCCAAAGAGCTGGCCATCAACGCCTACCAGA<br>GCAGAAAGGCCTGA |
| | TracrRNA<br>(SEQ ID<br>NO: 1121) | TTGACAAAACACTGAACCTTGATAATAGAATAGTAATTAACAATAGCGCCGCAGTTCATGTTGTTGATCAACCTCTG<br>AACTGAGATAAATGTGGGTTAGTTTGACTGTTGTGAGACAGTCTTGCTTTCTGACCCTGGTAGCTGCCCACCTTGAT<br>GCTGCTGTTTCTTGTAAACAGGAATAAGGTGCGCCCCAGTAATAGAGGTGCGGGTTTACCGCAGTGGTGGCTACCG<br>AATCACCTCCGAGCAAGGAGGAATCCACCTTAATTATTTATTTTTGGCGAACCATAAGCGAGGTCAATTTCCCTGGG<br>GTTCTGCCAAAAGTCCAAATCCCTTGTCTAGTCTGTTTTTCAGATGTTGAGATGCTTTGAAAATGTTCCCTTTAAAGG<br>GAAATTAAGAGCAAATTTAGGACATCCGCCAAAATTGCTTTTGGAAGTGTCACTAAATAAGGGTTTGGTCGGGCGG<br>A |
| | DR<br>(SEQ ID<br>NO: 1122) | GTTTCAACACCCCTCCCGGAGTGGGGCGGGTTGAAAG |
| | sgRNA<br>(SEQ ID<br>NO: 1123) | TTGACAAAACACTGAACCTTGATAATAGAATAGTAATTAACAATAGCGCCGCAGTTCATGTTGTTGATCAACCTCTG<br>AACTGAGATAAATGTGGGTTAGTTTGACTGTTGTGAGACAGTCTTGCTTTCTGACCCTGGTAGCTGCCCACCTTGAT<br>GCTGCTGTTTCTTGTAAACAGGAATAAGGTGCGCCCCAGTAATAGAGGTGCGGGTTTACCGCAGTGGTGGCTACCG<br>AATCACCTCCGAGCAAGGAGGAATCCACCTTAATTATTTATTTTTGGCGAACCATAAGCGAGGTCAATTTCCCTGGG<br>GTTCTGCCAAAAGTCCAAATCCCTTGTCTAGTCTGTTTTTCAGATGTTGAGATGCTTTGAAAATGTTCCCTTTAAAGG<br>GAAATTAAGAGCAAATTTAGGACATCCGCCAAAATTGCTTTTGGAAGTGTCACTAAATAAGGGTTTGGTCGGGCGG<br>AGAAATCCCGGAGTGGGGCGGGTTGAAAGNNNNNNNNNNNNNNNNNNNNNNNN |
| | LE<br>(SEQ ID<br>NO: 1124) | TCTAACGATAACGAATAATGATAAATACCGTAGTGCAATATTATGCTACAGGAAACTTAATCAGTGTTTACATAATT<br>TGTGTACATTAACTTATTATTTGACAATTTAACAAAATATTGTCAAAAATCATAAAAATACCTTAAAACCTTCTACA<br>GCAAAGATTGTAGGAGGTTTTTATTTATCAATTTGTGAACATCCTCCAGACATATATTTAACAAATTAAGTGTCAA<br>AAGCCAGATAATTATCAATTTATTTGTCAATTTGCCAAATACAGGTAAATTACTATATTTCTGAAAATTTCACACATT<br>AAATGTCACTTTTACTCTATACTATACAAATATGTTGTAATTAAACATTAATGTATATGAGGAATGAAACACCTCTA<br>ACTCCGGGCAATTTGGGAGATGAAAGTAGCATCGGCAAAGAAACTCAAGTTCTTGTGTCGGAACTTTCTGGCGAGG<br>CAAAACTAAAAATGGAGGTTATTCAAAGTCTGTTAGAA |
| | RE<br>(SEQ ID<br>NO: 1125) | GTTTCAACACCCCTCCCGGAGTGGGGCGGGTTGAAAGACATTAATGCAAGTAGAATAAAAAATATCTAGGTGGGTT<br>GAAAGATCAGTAGGTCGTGGGTTTAACTCTGAAAACACTTGAAAACACTATATAAATACAGTGTTGCTTGTGACATT<br>TAGGGACAATTAATTTGTTAACAGTGACGAATTAGTTAAAAATGACATTAATTTTGTTAACAGTGACAAATAAATT<br>GTTAATGACATAGATATAGTGTGCGAATGTACACCCAAAGCCGATGATGGGATTTGAACCCACGACCTACTGATTA<br>CGAATCAGTTGCTCTACCCCTGAGCCACATCGGCATACACAGTTTGATATCATAGCATTATTTACCTATGATAGACC<br>CAAATTCCCAAATCGTCTTAACTCTAAACAATATGCCCACCTGAAAGCTGAAATAGCAGCCCCTTATCGTGGTTTG<br>CGGCAATTTATCTATATAGGTGTTGGTGCTTCTGGTTTTA |
| LJOS01000007/<br>Anabaena<br>sp. WA113/<br>T51 | TnsB<br>(SEQ ID<br>NO: 1126) | ATGAACCGGGACGAGAACAGCGACCTGAACACCAGCGCCATTCCAGTGGAATCCATCAGCGAGGGCGACAACACC<br>CCTCCTGAGACAAATGTGATCGCCACCGAGCTGAGCGAGGAAAGCCAGCTGAAACTGGAAGTGCTGCAGAGCCTGC<br>TGGAACCCTGCGACAGAACAACCTACGGCCAGAAGCTGAAAGAGGCCGCCGAGAAACTGGCTGTGTCTGTGCGAA<br>CAGTGCAGCGGCTGGTCAAGAAGTGGGAGCAAGACGACGTCGTGGGCCTGACACAGACCGGCAGAACAGATAAGG<br>GCAAGCACCGGATCGGCGAGTTCTGGGAAGATTTCATCGTGAAAACCCACAAAGAGGGCAACAAGGGCAGCAAGC<br>GGATGAGCCCTAAACAGGTGGCCATCAGAGTGCAGGCCAAGGCTCACGAGCTGTCCGATCTGAAGCCTCCTAACTA<br>CCCGGACCGTGCTGAGAGTGCTGGCCCCTATCCTGGAAAAGCAAGAAAAGACCAAGAGCATCAGAAGCCCCGGCTG<br>GCGGGGAACAACACTGAGCGTGAAAACAAGAGAAGGCAAGGACCTGAGCGTGGACTACAGCAACCACGTGTGGCA<br>GTGCGATCACACCCCTGCTGATGTGCTGCTGGTGGATCAGCATGGCGAGCTGCTGTCTAGACCTTGGCTGACCACCG<br>TGATCGACACCTACAGCAGATGCATCATGGGCATCAACCTGGCTTCGACGCCCCTAGCTCTGAAGTGGTTGCTCTG<br>GCCCTGAGACACGCCATCCTGCCTAAGAGATACAGCCTCGAGTACAAGCTGCACTGCGAGTGGGGCACATACGGCA<br>AGCCTGAGCACTTCTACACCGACGGCGGCAAGGACTTCAGAAGCAACCACCTGTCTCAGATCGGCGCTCAGCTGGG<br>CTTTGTGTGCCACCTGAGAGACAGACCTAGCGAAGGCGGCATCGTGGAAGACCCTTCAAGACCCTGAACGATCAG<br>CTGTTCAGCACCCTGCCTGGCTACACCGGCAGCAATGGCTGCAAGAAAGACCCCGAGGATGCCGAGAAGGACGCCAAGC<br>TGACACTGAGAGAGCTGGAACAGCTCATTGTGCGGTACATCGTGGACCGGTACAACCAGAGCATCGACGCCAGAAT<br>GGGCGACCAGACCAGATTCGGAAGATGGGAAGCCGGCCTGCCTTCTGTGCCTGTGCCTATCGAGGAACGCGACCTG<br>GACATCTGCCTGATGAAGCAGTCTCGGCGGAGAGTGCAGAAAGGCGGCCATCTGCAGTTCAGAACCTGATGTACC<br>GGGGCAGTACCTCGGCGGCTATGATGGCGAAACCGTGACCTGAACCTGCGGTTCAACCCCAGAGACATCACCACCGTGCT<br>GGTGTACCGCAAGAGAACAGCCAAGAGGTGTTCCTGACCAGGGCTCATGCCCAGGGACTCGAGACAGAACAGCT<br>GTCCCTGGATGAAGCCGAGGCCGCATCTCGGAGACTGAGAAATCTGGGCAAGACCATCAGCAATCAGGCCCTGCTG<br>CAAGAGGTGCTGGACAGAGATGCACTGGTGGCCAACAAGAAGTCCCGAAGGACAGACAGAAGCTCGAGCAAGAG<br>ATCCTGAGAAGCACCGCCGTGAACGACAGCAAGAACGAGTCTCTGGCTAGCCCCGTGATGGAAGCTGAGGACGTGG<br>AATTCACCACACCTGTGCAGAGCAGCAGCCCCGAGCTGGAAGTGTGGGATTACGAGCAGCTGCGGGAAGAGTACG<br>GCTTCTGA |

TABLE 27-continued

| Name/Organism/System ID (T) | | Sequences |
|---|---|---|
| | TnsC (SEQ ID NO: 1127) | ATGACCGATGACGCCCAGGCCATTGCCAAACAGCTCGGCGGAGTGAAGCCCGACGAAGAATGGCTGCAGGCCGAG<br>ATCACACACCTGACCAGCAAGAGCATCGTGCCCCTGCAGCAAGTGATCACCCTGCACGATTGGCTGGACGGCAAGA<br>GAAAGGCCAGACAGAGCTGTAGAGTCGTGGGCGAGAGCAGAACCGGAAAGACCGTGGCCTGTGACGCCTACCGGT<br>ACAGACACAAGCCCAGACAAGAGATGGGCAAGACCCCTATCGTGCCCGTGGTGTACATCCAGCCTCCATCTAAGTG<br>CGGCGCCAAGGACCTGTTCCAAGAGATCATCGAGTACCTCGAAGTTCAAGGCCACCAGAGGCACCATCAGCGACTTC<br>AGAGGCCGGACCATGGAAGTGCTGAAGGGCTGCAGAGTGGAAATGATCATCATCGACGAGGCCGACCGGATCAAG<br>CCCGATACCTTTGCTGACGTGCGGGACATCTACGACAAGCTGGGAATCGCCATCGTGCTCGTGGGCACCGATAGACT<br>GGAAGCCGTGATCAAGCGGGACGAACAGGTGTACAACCGGTTCAGAGCCTGCCACAGATTCGGCAAGCTGGCCGG<br>CAAGGACTTCCAGGATACAGTCCAGGCCTGGGAAGATAAGATCCTGAAGCTGCCCCTGCCTAGCAACCTGATCTCC<br>AAGGACATGCTGCCGGATCCTGACAAGCGCCACCGAGGGCTATATCGGCGGACTGGATGAGATCCTGAGAGAGGCC<br>GCCATCAGAAGCCTGTCCAGAGGCCTGAAGAAAATCGACAAGGCCGTGCTGCAAGAGGTGGTGCAAGAGTTCAAG<br>CTGTGA |
| | TniQ (SEQ ID NO: 1128) | ATGATCCAGCCTTACGAGGGCGAGAGCCTGAGCCACTTCCTGGGCAGATTCAGAAGGGCCAACCACCTGTCTGCTG<br>CCCGGCCTGGGAAATCTGGCTGGAATCGGAGCCGTGATCGCCAGATGGGAGAGATTCCACTTCAACCCCAGACCTAG<br>CCAGAAAGAGCTGGAAGCCATTGCCAGCGTGGTGGAAGTGGATGCCCAGAGACTGGCCGAAATGTTGCCTCCTGCT<br>GGCGTGTCCATGCAGCACAGCCTATTAGACTGTGCGGCGCCTGTTACGCCGGACACCTTGTCACCAGATCAAGTG<br>GCAGTTCAAAGAGACAGGCGGCTGCGACCGGCACTACCTGAGACTGCTGAGCAAGTGCCCTAACTGCGACGCCAGA<br>TTCAAGATCCCCGCTCTGTGGGAGCTGGGCGTGTGTCAGAGATGCCTGATGACCCTTTGCCGAGATGGCCGGCTACCA<br>GAAGTCCATCAACGGCACCTAA |
| | Cas12k (SEQ ID NO: 1129) | ATGAGCCAGATCACCGTGCAGTGCAGACTGATCGCCAGCGAGAGCACAAGACAGCAGCTGTGGACACTGATGGCC<br>GAGCTGAACACCCCTCTGATCAACGAGCTGCTCCAGCAGCTGAGCAAGCACCCCGATTTTGAGAAGTGGCGGAAGG<br>ACGGCAAGTTCCCCAGCACAGTGGTGTCTCAGCTGTGCCAGCCTCTGAAAACCGATCCTCAGTTTGCCGGCCAGCCT<br>AGCAGATGTTACCTGAGCGCCATCCACGTGGTGGACTACATCTACAAGAGCTGGCTGACCATCCAGAAGCGGCTGC<br>AGCAACAGCTGGATGGCAAGATCCGGTGGCTGGAAATGCTGAACTCCGACGCCGAGCTGGTGGTGGAAACAAGCGGCT<br>ATTCCCTGGAAGCCATCAGGACAAAGGCCGCCGAGATCCTGGCCATGACAACCCCTGAGAGCGACACCAATGTGCC<br>CCTGACCAAGAAGCGGAACACCAAGAAGTCTAAGAAGTCCAGCGCCAGCAATCCCGAGCCTAGCCTGAGCCACAA<br>GCTGTTCAACGCCTACCAAGAGACAGACGACATCCTGAGCAGAAGCGCCATCAGCTACCTGCTGAAGAACGGCTGC<br>AAGCTGAACGACAAAGAAGAGGATACCGAGAAGTTCGCCAAGCGGCGGAGAAAGTGGAAATCCAGATCCAGCGG<br>CTGACCGACAAGCTGACCAGCAGAATCCCCAAGGGCAGAGATCTGACCAACAGCAAGTGGCTCGAGACACTGTTCA<br>CCGCCATCACCACCGTGCCTGAGGATAATGCCGAGGCCAAGAGATGGCAGGACATCCTGTCTACCAGAAGCAGCAG<br>CCTGCCTTTTCCACTGATCTTCGAGACAAACGAGGACCTGAAGTGGTCCACCAACGAGAAGGGCAGACTGTGCGTG<br>CACTTCAACGGCCTGACCGACCTGACCTTCGAGGTGTACTGCGACAGCAGACAGCTGCACTGGTTCAAGCGGTTTCT<br>GGAAGATCAGCAGACCAAGCGGAAGTCCAAGAACCAGCACAGCAGCAGCCTGCTTGTTCACCCTGAGAAATGGCAGACT<br>GGCCTGGCAAGAAGGCGAAGGCAAAGGCGAGACATGCAGATCCACAGACTGACCCTGAGCTGCTGCGTGGACAA<br>CAGACTGTGGACTGCCGAGGGCACAGAGCAAGTGCGGCAAGAGAAGGCCGAGGACATCACCAAGTTTATCACCAA<br>GATGAAGGAAAAGAGCGACCTCAGCGACACCCAGCAGGCCTTCATCCAGAGAAAGCAGAGCACCCTGACCAGGAT<br>CAACAACGACTTCGACAGACCCTGCAAGCCCCTGTACCAGGACCAGTCTCATATCCTCGTGGGCGTGTCCATGGGCC<br>TCGAGAAACCTGCTACAGTGGCCGTGGTGGATGCCAGCGCTAACAAGGTGCTGACCTACCGGTCCATCAAGCAGAT<br>CCTGGGCGAGAACTACGAACTGCTGAACCGGCAGCGGAGACAGCAGAGAAGCAGCTCTCACGAGAGACACAAGGC<br>CCAGAAGTCTTTCAGCCCCAACCAGTTCGGCACAAGCGAGCTGGGCCAGTACATCGATAGACTGCTGGCCAAAGAA<br>ATCGTGGCTATCGCCCAGACCTACAAGGCCGGCTCTATCGTGCCTAACGTGGAAGACATGAGAGGAACATCC<br>AGAGCGAGATCCAGGCTATTGCCGAGATCAAGTCGCCCCGGCAGCGTGGAAATTCAGCAGAAGTATGCCAAGCAGTA<br>CCGGATCAACGTGCACAAGTGGTCCTACGCAGGCTGATCCAGAGCATCCAGTCCAAGGCTGCCCAAGTGGGCATC<br>GTGATCGAAGAGGGAAAACAGCCCGTGCGGGACAGCCCTCAGGATAAGGCTAAAGAACTGGCTCTGAGCACCTAC<br>CACCTGAGGCTGGCTAAGCAGAGCTGA |
| | TracrRNA (SEQ ID NO: 1130) | CAAATATCCGAACCTTGACAATAAAATAGATTTAATAGCGCCGCCGTTCATGCTGCTTGCAGCCTCTGAACAGTGTT<br>AAATGGGGGTTAGTTTGACTGTAGCAATACAGTCTTGCTTTCTGACCCTGGTAGCTGCTCACCCTGATGCTGCTGTCT<br>TAGGACAGGATAGGTGCGCTCCCAGCAATAAGGGTGCGGATGTACCGCTATAGTGGCTACCGAATCACCTCCGATC<br>AAGGGGGAACCCTCCTCAATTCTTCATTTGAAGAACTAAAATCAAGGCAAAATTTCTCAGAGATCCGCGCAAGTCC<br>CAAATGCTTGTCCTGTCGAAATCTCATCGTTTTTTCATCCTGATATGATTTTATGACTGAGGCTCAAATAGCAAAT<br>TGGGAGACATCCGCGCTAACGACACCTGGAAACCTTGCCCCACAATACTTTGAAACTAGATG |
| | DR (SEQ ID NO: 1131) | GGTAACAACAACCCTCCTAGTACAGGGTGGGTTGAAAG |
| | sgRNA (SEQ ID NO: 1132) | CAAATATCCGAACCTTGACAATAAAATAGATTTAATAGCGCCGCCGTTCATGCTGCTTGCAGCCTCTGAACAGTGTT<br>AAATGGGGGTTAGTTTGACTGTAGCAATACAGTCTTGCTTTCTGACCCTGGTAGCTGCTCACCCTGATGCTGCTGTCT<br>TAGGACAGGATAGGTGCGCTCCCAGCAATAAGGGTGCGGATGTACCGCTATAGTGGCTACCGAATCACCTCCGATC<br>AAGGGGGAACCCTCCTCAATTCTTCATTTGAAGAACTAAAATCAAGGCAAAATTTCTCAGAGATCCGCGCAAGTCC<br>CAAATGCTTGTCCTGTCGAAATCTCATCGTTTTTTCATCCTGATATGATTTTATGACTGAGGCTCAAATAGCAAAT<br>TGGGAGACATCCGCGCTAACGACACCTGGAAACCTTGCCCCACAATACTTTGAAACTAGATGGAAATCCTAGTACA<br>GGGTGGGTTGAAAGNNNNNNNNNNNNNNNNNNNNNNNN |
| | LE (SEQ ID NO: 1133) | TTTAAGTATAGTAGTATTATCAAGGGTAAAAATGTCAACATTTTCATAATATCTTCCATCCAATGAACATAACTGATT<br>TGTTGACACATACAAGATTGAAGATAGCGGAATTTATCTAACATCTTTTCACCCCATTCTTTCGGAACAGATAAATG<br>TACAGTGACTAATTATATGTCATCGTGACAAATTAATGTCATCTTATAAATCCTTGCTGTAGAAGGATTTTAGCAATT<br>TAACGATATTATACTTCAATCCAGTTAGTGACAAAATAAATGTCGTTTCCCATGATTGTGACAAATTAACTGTCGCG<br>TTACCGATTAAAAAAAGTTTTTGTATATTTTCATAATGACAAATTGACTGTCGCTTTCCAGTAAGCTAGAATAACATC<br>ATGTTTTTATAAAATCTGTTTGATTTATGAACAGAGATGAAAATTCAGTTTAAATACCTCAGCTATCCCTGTGGAAA<br>GCATATCAGAAGGAGACAACACACCTCCTGAGACA |
| | RE (SEQ ID NO: 1134) | GGTAACAACAACCCCACCCTATGGTGGGTTGAAAGGTTATCATATTCTTATAAAAGAGGGTTGAAAGAGAGTACAT<br>CGTTGACATATCGCTCTGATATATCATAATTAATTTGTCATCTACCATTAAACAGCAACAATTTGTCCTA<br>ACGACACTAAATTGTCACCGACGACATATAATTAGTCACTGTCAAAAGTATGGACGGTATTGGACTGCAACCAA<br>CGACCCCATCGATGTCAACGATGTACTCTAACCACCTGAGCTAACCGTCCTTAATCCCATAGCTAATAACGTATCA<br>CATAAAATATAATTTGTCAATCCCTAAAATCCAATTTTATTCTACATATATCTAGTCAACTGTACCCGATAGCGATC<br>CTTTTTTTGTCACCGCAATTTCCCAACTTCCAACCGACCTTTTCCCCGAATAGCGATTAAATCCCCTGTTTTCACTTG<br>AGAACTGGCTTGAGTGACTTCCTTCCAATTGACACGCA |

TABLE 27-continued

| Name/<br>Organism/<br>System<br>ID (T) | | Sequences |
|---|---|---|
| PEBC01000041/<br>*Cyanobacterium aponinum*<br>IPPAS B-1201/<br>T52 | TnsB<br>(SEQ ID<br>NO: 1135) | ATGACCATCGACAACCAGTTCAGCGACAGCCCCGAGCTGATTAGCCAGCTGTCTCCCGAGGACCAGAAAATCGCCG<br>ACGTGATCGAGAACCTGCTGCAGCCCTGCGACAAGAAAACCTACGGCAAGAAGCTGAAGCAGGCCAGCGACCAGC<br>TGAAGAAAAGCGTGCGGACCATCCAGAGATACGTGAAGCAGTGGGAAGAGAACGGCCTCGTGGGCATCCTGCAGA<br>ACAACAGAGCCGACAAGGGCAGCTACCGGATCGACCCTAGACTGCAGGACTTCATCCTCAAGACCTACAGAGAGG<br>GCAACAAGGGCTCCAAGCGGATGACCCCTAAACAGGTGTACCTGAGAGCCGTGGTGCAGGCCGAGAATTGGGGAA<br>TCAAGCCTCCTAGCCACATGACCATCTACCGGATTCTGAACCCCATCATTGCCGAGAAAGAGAACAAGAAGCGGAT<br>CAGAAGCAGCGGCTGGCGGGGATCTCAACTGGTGCTGTCTACAAGATCCGGCACCGAGATCGACGTGCAGTACAGC<br>AATCACGTGTGGCAGTGCGACCACACCAGAGCCGATATCCTGCTGGTGGATCAGTTCGGCGAACTCCTGGGCAGAC<br>CCTGGATCACCATTGTGGTGGACACCTACAGCCGGTGCATCATGGGCATCAACCTGGGCTTTGATGCCCCTAGCAGC<br>CAGGTTGTGACACTGGCCCTGAGACACGCCATCCTGCCTAAGAGCTACAGCAGCGACTACGAGCTGCACGAGGAAT<br>GGGGCACATACGGCAAGCCCGAGTACTTCTACACCGACGGCGGCAAGGACTTCAGAAGCAACCATCTGCAGCAGAT<br>CAGCCTGCAGCTGGGCTTCACCTGTCACCTGAGAAGCAGACCTAGCGAAGGCGGCGTGGTGGAAAGACTGTTCAAG<br>ACCCTGAACACAGAGGTGTTCAGCACCCTGCCTGGCTACACAGGCGCCAATGTGCAAGAAAGACCCGAGGACGCCG<br>AAAAAGAGGCCTGTCTGACCCTGAAAGAGCTGGAAATCCTGATCGTGCGGTACATCGTGGACAACTACAACCAGCG<br>GATCGACGCCAGAATGGGCGAGCAGACCAGATTCCAGAGATGGGAGAGCGGCCTGCTGAGCACCCCTCACATTATC<br>CCTGAGCGCGAGCTGGACATCTGCCTGATGAAGCAGTCCAGACGGAAGGTGCAGAAAGGCGGGCATCTGCAGTTCG<br>AGAATCTGATCTACAAGGGCCAGTACCTGGCCGGCTATGAGGGCGAGACAGTGATCCTGAGATACGACCCCAGAGA<br>CATCACCGGCATCCTGATCTATCGCGTCGAGAACAACAAAGAGATCTTCCTGACCAGAGCCTACGCCACCGACCTG<br>GAAGGCGATTGTCTGAGCCTGACCGATGCCAAGAGCAGCGTGAAGAGAATCCGCGAGAAGTCCAAGAACGTGCAC<br>AACAAGTCCATCCTGATGGAAATCCAGCAGCGGCACCTGTTCAGCGAGAAGAAAACAAAGAAGCAGATTCAGCAA<br>GAGGAACAGAAACAGATCAAGCCCAACACCAGCCTGAGCATCTTCAAGCCCGAAACCGAGATGGACACCCAGGTG<br>GAAAGCAGCCTGCAAGAGCTGAGCGAAGAGGACCTGGACATCGACATGATCGACTACGGCAACCTGCAGCAGTACTGA |
| | TnsC<br>(SEQ ID<br>NO: 1136) | ATGGAAGCCAAAGAGATCGCCCAGCAGCTGGGAGAAGTGGAACAGCCCAATCAGAGCCTGCAGAACGAGCTGGAC<br>CGGCTGAGCAAGAAGCAGTTCCTGTTCCTGGACCAAGTGAAGATCTACCACCAGTGGCTGAACGAGCGGCTGTTCA<br>TGAAGCACTGCTGCAGAGTCGTGGGCGATAGCCACACAGGCAAGACATCTAGCAGCCAGGCCTACTGCCTGCGGTA<br>CAAGAGCACACAAGAGAGCGGCAAGAACCCTATCTTCCCCGTGCTGTACGTGTCCGTGCCTGAGAATGCCACCAGC<br>AAGGTGTTCTTCGAAACCAGCATCAAGAGCTTCGGCTACCGGATCAGCAAGGGCACCATCAGCGACCTGCGGGAAA<br>GAATGCTGACCCTGCTGAGCCGGTGCCAAGTGAAAATGATGATCATTGACGAGGCCGACCGGTGCAAGCCCGAGAC<br>ACTGAGCTACATCCGGGACATCTTCGACCACCTGAACATCTGCATCGTGCTCGTGGGCACCGACAGACTGAACACC<br>GTGCTGAAGAGGGACGAACAGGTGTACAACCGGTTCCTGCCTTGCTACAGATACGGCCTGCTGGACAAAGAGAGCC<br>TGATCAAGACCATCAAGATCTGGGAGATCAAGATCCTGAAGCTGCCCGTGGCCAGCAATCTGAGCCAGGGCAAGAA<br>GTTCAACATCATCTACAGCACCTCCAAGGGCTGCCTGGGCACCATGGATAAGCTGCTGAGAACAGCGCCAGCATG<br>GCCCTGATCAGAGGACTGTCCAAGATCGAGCTGAACATCCTGGAAGAGGCCGCTCACCTGTTCAAGGACAAGTGA |
| | TniQ<br>(SEQ ID<br>NO: 1137) | ATGATCACCAACAGCTTCGACAGCTGGATCCTGATGCTGGACCCTTACCAGGGCGAGAGCATCAGCCACTTTCTGGG<br>CAGATTCCGGCGCGAGAATAGCCTGACCGTGAACAACCTGGGCAAAGCCACAGAGCTGTACGCGCCATTGCCAGA<br>TGGGAGAAGTTCCGGTTCAACCCTCCACCTAGCAGCGAGCAGCTGAAGAAACTGAGCGCCATCGTGCAGGTCGAGG<br>TGGCCACACTGCAGACCATGTTTCCCAGCGCTCCCATGAAGATGACCCCTATCAGACTGTGCAGCGCCTGCTACGGC<br>GAGAAGCCCTACCACAAGATGGAATGGCAGTACAAAGAAATCTACAAGTGCGACCGGCACCAGCTGAAGCTGCTG<br>AGCGAGTGTCCTAATTGCGGCGCCAGATTCAAGTTCCCCAGCCTGTGGGTTGACGGCTGGTGCCACAGATGCTTCAC<br>CCCTTTCGCCGAGATGAAGCAGCAGAAGGACTGA |
| | Cas12k<br>(SEQ ID<br>NO: 1138) | ATGGTGCAAGTGACCATCCAGAGCAGACTGATCGCCAGCGCCGATACCAGACAGTCTCTGTGGCTGCTGATGAGCA<br>AGAAGAACACCCCTCTGATCAACGAGATCCTGACGCGGATCAAGCACCATCCTGACTTCCCTCAGTGGCGCGAGAA<br>AGGCAGACTGCCCAAGAACTTTATCGCCCAGCAGATCCAGATCCAAGAGCTGAAGAACGACAGCCGGTTCCAGGGCCAGCCT<br>AGCAGATTCTATGCCAGCGTGGCCAAGATCATCGACTACATCTACAAGAGCTGGTTCAAGCTGCAGAAGTCCTACA<br>AGATTCAGCTGGAAGGCAACAGCCGGTGGCTGGAAATGCTGAAGCCTGACAGCCTGCTGATCGAGAGCTTCGACGG<br>CTCCTATGGAAGCCCTGCAGAATCAGGCCCAGCAAATCCTGGACAACATCGAGACAACCAGCACACAAGAGGGCATC<br>GTGGACTACCTGTTCCAGAAGTACGAGAAGATCGAGAACTGCCGGATGAAGGACGCCATCGTGTACCTGATCAAGA<br>ACGGCAGCAGAATCCCCAAGAACAATATCGAAACCACCAAGAAGTACAAGCGCATCAAGCGGAAGCTCGAGATCA<br>AGATCCGGAAGCTGAAGCGCCAGGTGGAAATGAGCATCCCCAGCGGCAGAGATCTGGAAGGCGAGAAGTGGCTGC<br>ACACCCTGATCCTGGCCAGCAACACCATGCCTGTGGATCAGAGCGAGGACAGCTGGTTAGCGCCCTGAAGAG<br>AAACAGCCCTAGCATCCCCTATCCTATCGTGTACGAGAGCAACGAGGACCTGACCTGGTGCCTGAACAACCAGAAC<br>CGGATCTGCATCAAGTTCAGCGGCCTGAGCGACCACCTGTTTCAGATCTACTGCGACAGCAGGCAGCTGGCCTACTT<br>CAGACGGTTCTACGAGGACCAAGAACTGAAAAAGGCCAGCAAGGACCAGTTCAGCAGCGCCCTGTTTACCCTGAGA<br>AGCGCCATGATCATCTGGAAAGAGGACGACGGCAAGGGCGAGAGCTGGGACAAGCACAAGTGTACCTGCACTGC<br>ACCTTCGACACCGACTACTGGACCGTGGAAGGCACCCAAGTGATCGCCCAGAAAAAGCAAGAGGAAGTCCTGAAC<br>CTGATCGACCGCATGAAGGAAAAGACCGACCTGACCGACACACAGAAGGCCTTTATCCAGCGGAAGCAGACCCACA<br>CTGGCCCGGCTGAACAACATCTTCCCCAGACCTAGCAAGCCCATCTACCAGGGCAACCCCAATCTGTTTCTCGGCGT<br>GGCCATGGGCCTGCAAGAGCCTGTTACAATCGCCCTGGTGGATGTGTCCACCAACAAAGTGATCCTGTACCGGAAC<br>ATCAAACAGCTGCTGGGAGACAACTACCATCTGCTGCGGAGAAGGCGAACGAGAAGCAGAAGCTGAATCACCAG<br>AACCACAAGGCCCGGAAGCGGGCCAATTTTCAGCAGAAGGGCGAGTCCAACCTGGGCAGTACCTGGACAGACTG<br>ATTGCTAAGAGCATCCTGCAGATCGCCAAAGAATACCAGGTGTCCACAATCATCGTGCCCAGACTGAACCAGATGC<br>GGAGCATCACCGAGGCCGAGATTCAGGCCAGAGCCGAGGAAAGAATCCCCGAGTACAAAGAAGGCCAGAGGAAGT<br>ACGCCCAGGACTACAGAGTGCAGGTCCACCAGTGGTCCTACGCAGGCTGATCGACAACATCAAGGCCATCAGCTC<br>CAAGCTGGGAATCGTGGTGGAAGAGGGCAAGCAGCCTAAGCAGGGCACCTTCACAGATAAGGGCCTCTCAGCTGGCT<br>CTGAGCACCCAGAAGAACAACCGGCAGAACAACCCCAAAAAGACCAACAGCTGA |

TABLE 27-continued

| Name/<br>Organism/<br>System<br>ID (T) | | Sequences |
|---|---|---|
| | TracrRNA<br>(SEQ ID<br>NO: 1139) | GTTACAATGAGGGAAATCGTGCCGCCGATCAAGTTGTTGTCAACCTCTGTTCTGCGAAAAATGAGGGGTAGTTTACC<br>TAGTAATAGGTTTGCTTTCTGTCCCTGATAACTGCTCACTCTGATGCTGCGCACTGAATAAAGTGCGGAAACAAGGG<br>GCACTCCCAGCAAAAGGAGTTTGGGTGTACCAATGTAGTGGTTTATCCAATCACCTCCGATCAAGGAGGAATCCCAA<br>TTTAAGCGTTAGTTAAAATGTACGAGTTACACTAATTCGGATTTTATCCTTACGCAATCGCTGAAACTCCTATAAATT<br>AAGAGATATAGCGTTTTAAGAAAATGCAGAATTCCAGTCAAAATCAGAATTTTCGTATTTTTAGAGGTGGCTTACGC<br>AAACTGCTTTTACAAGCCTTATTTTATAAGGACTCTGACTAGGGGCA |
| | DR<br>(SEQ ID<br>NO: 1140) | GTTGAAATAAGACAATACCTTCTATAGGGATTGAAAG |
| | sgRNA<br>(SEQ ID<br>NO: 1141) | GTTACAATGAGGGAAATCGTGCCGCCGATCAAGTTGTTGTCAACCTCTGTTCTGCGAAAAATGAGGGGTAGTTTACC<br>TAGTAATAGGTTTGCTTTCTGTCCCTGATAACTGCTCACTCTGATGCTGCGCACTGAATAAAGTGCGGAAACAAGGG<br>GCACTCCCAGCAAAAGGAGTTTGGGTGTACCAATGTAGTGGTTTATCCAATCACCTCCGATCAAGGAGGAATCCCAA<br>TTTAAGCGTTAGTTAAAATGTACGAGTTACACTAATTCGGATTTTATCCTTACGCAATCGCTGAAACTCCTATAAATT<br>AAGAGATATAGCGTTTTAAGAAAATGCAGAATTCCAGTCAAAATCAGAATTTTCGTATTTTTAGAGGTGGCTTACGC<br>AAACTGCTTTTACAAGCCTTATTTTATAAGGACTCTGACTAGGGGCAGAAAAATACCTTCTATAGGGATTGAAAGNN<br>NNNNNNNNNNNNNNNNNNNNN |
| | LE<br>(SEQ ID<br>NO: 1142) | ATACAAGAATCAAAAAATTTGAAAATTACAAAGGCTTACGGAGTTTGACAAAAGAAAGAGTATTGATTCAAGTTTA<br>AGTAAGATAGTAAGCTCTTGTACAGTAACAAATTAAATGACGTGATAACAAATTAGTGTTATCTAAAAATAAGACT<br>CTTCAAATCTTTGCATATCAATAATTATAACTAATTCTTCCCCTAAAACAAGGAGCGATCGCACCTCAAATGGGATT<br>AACAAATTAAGTGTCATCTTCCAGAAAAATAAACAAATTAAATGTCGTCTTTCTAAAAGGCGATTTTTTGTTTTAGGG<br>GTTGTCATTAACAAATTAGATGTCCTAAGATTAGTATAAAACCATTATGATTTTATTAAACAGCTAAGAGAAAACTA<br>TGACCATCGATAATCAATTTTCTGATTCTCCAGAATTGATCTCTCAACTTTCTCCCGAAGACCAAAAAATCGCTGATG<br>TTATTGAAAATTTACTTCAACCTTGTGACAAGAAAACTT |
| | RE<br>(SEQ ID<br>NO: 1143) | GTTGAAATAAGACAATACCTTCTATAGGGTTTATAATATTAATAGTGCCGTAGATCAAGTTTTCATAACCTCTGTTCT<br>ATGAAAAATGAGGAGTAGTTTACTTCTTATAAGAAGTTTGCTTTCTGCTTCTGCTAACTACTTGCCCTGATGCTGTCT<br>ATCTTAAAGATAGAGAAACTAGGCGCACTCCCAGCAATAAGGGTGCAGGTGTACTGCTATAGCGGTTAGCGAATCA<br>CTTCCGAGCAAGGAAGAATTCTCTTTGAGAATTGAAAGCGAGTCCCTCCACGTCCTAGTCATTGAATTGGCGACATT<br>AATTTGTGATCACGTCATTTAATTTGTTAAGACGACATTAATCTGTTACCGATGACAAATAATTTGTTACTGTACAGC<br>TCTAATCTTTTAGAGTTAACTGTTATGACTTTGGAGCTATCTATAATTTATTTACGGGCGTGGAGGGACTCGAACCCC<br>CGACCTGCTGATCCGTAGTCAGCCGCTCTAATCCA |
| PGEM01000038/<br>Cuspidothrix<br>issatschenkoi<br>CHARLIE-1/<br>T53 | TnsB<br>(SEQ ID<br>NO: 1144) | ATGTACATGCGGAACGAGACACCCATCACACCCGACAACCTGGAAACCGAGAGCGTGACCGCCAAGGACACCCAG<br>ATCATCGTGTCTGAGCTGAGCGACGAGGCCAAGCTGAAGATGGAAATCATCCAGAGCCTGCTGGAAGCCGGCGACA<br>GAACAACATACGCCCAGAGACTGAAAGAGGCCGCCGTCAAGCTGGGAAAGTCTGTGCGGACAGTGCGGCGGCTGA<br>TCGACAAGTGGGAACAAGAGGGACTCGTGGGCCTGACACAGACCGACAGAGTGGATAAGGGCAAGCACCGCGTGG<br>ACGAGAACTGGCAAGAGTTCATCCTGAAAACCTACAAAGAGGGCAACAAAGGCGGCAAGCGGATGACCAGACAGC<br>AGGTCGCCATCAGAGTGAAAGTGCGGGCCATCAGCTGGGCGTGAAGCCTCCATCTCACATGACCGTGTACCGGAT<br>CCTGGAACCTGTGATCGAGAAGCAAGAGAAAGGCCAAGAGCATCAGAACCCCTGGCTGGCGGGGAAGCAGACTGAG<br>CCTGAAACAAGAGATGGCCTGGACCTGAGCGTGGAATACTCCAACCACATCTGGCAGTGCGACCACACCAGAGCC<br>GATATCCTGCTGGTGGATCAGCACGGCGAACTGCTGGCTAGACCTTGGCTGACCACCGTGATCGACACCTACAGCA<br>GATGCATCATCGGCATCAACCTGGGCTTCGACGATCCCTAGTTCTCAGGTTGTGGCTCTGCCCTGAGCACACGCCATC<br>CTGCCTAAGAAGTATGCGCCGAGTACGCCTGCACGAGGAATGGGGAACATACGGCAAGCCCGAGCACTTCTTTA<br>CCGACGGCGGCAAGGACTTCAGAAGCAACCATCTGCAGCAGATCGGCGTGCAGCTGGGCTTTGCCTGTCACCTGAG<br>AGACTGTCCTAGCCAAGGCGGCATCGTGGAAAGACCCTTTCGGCACCCTGAACACCGACCTGTTCTCTACCCTGCCTG<br>GCTACACCGGCAGCAACGTGCAAGAAAGACCTGAGGAAGCCGAGAAAGAAGCCTGTCTGACCCTGAGAGAGCTGG<br>AACGGCTGCTCGTCAGATACCTGGTGGACAAGTACAACCAGAGCATCGACGCCAGACTGGGCGATCAGACCAGATA<br>CCAGAGATGGGAGGCCGGACTGATCGTGGCCCCTAACCTGATCAGCGAAGAGGACCTGCGGATCTGCCTGATGAAG<br>CAGACCAGGCGGAGCATCTACAGAGGCGGCTACCTGCAGTTCGAGAACCTGACATACCGGGGCGAGAATCTGGCCG<br>GATATGCCGGCGAATCTGTGGTGCTGAGATTCGACCCCAAGGATATCACCACCATCCTGGTGTACCGGCAGACCGG<br>CTTTCAAGAAGAGTTCCTGGCCAGAGCTTACGCCCAGGATCTGGAAACAGAGGAACTGTCCCTGGATGAGGCCAAG<br>GCCATGAGCAGAAGAATCCGGCAGGCCGGCAAAGAGATCAGCAACAGATCCATCCTGGCCGAAGTGCGCGACCGG<br>GAAACCTTCGTGAAGCAGCAGAAAAGACCAAGAAAGAGCCATCAGAAGACAAGTCGTCGTCGAGAAGGCCTCC<br>AGCGAGAAGCAGAACCGCAAGAAACCCGTGATCGTGGAACCCGAAGAGATCGAGGTGGCCAGCGTGGAAAAGC<br>AGCAGCGACACAGATATGCCCGAGGTGTTCGACTACGAGCAGATGAGAGAAGATTACGGCTGGTGA |
| | TnsC<br>(SEQ ID<br>NO: 1145) | ATGATCAGCCAGCAGGCTCAGGGCGTTGCCCAAGAGCTGGGAGACATCCTGCCTAACGACGAGAAGCTGCAGGCCG<br>AGATCCACCGGCTGAACAGAAAGAGCTTCATCCCTCTGGAACAAGTGAAGATGCTGCACGACTGGCTGGACGGCAA<br>GAGACAGACGACAGTCTGGCAGATGCTGGGCGAGAGCGAAACCGGCAAGACCATGGGCTGTGACGCCTACAG<br>ACTGCGGCACAAGCCTAAGCAAGAGCCCGGCAAACCTCCTACAGTGCCCGTGGCCTACATCCAGATTCCTCAAGAG<br>TGCAGCGCCAAAGAGCTGTTCGCCGCCATCATCGAGCACCTGAAGTACCAGATGACCAAGGGCACCGTGGCCGAGA<br>TTAGAGACAGAACCCTGCGGGTGCTGAAAGGCTGCGGAGTGGAAATGCTGATCATCGACGAGGCCGACCGGTTCAA<br>GCCCAAGACCTTTGCTGAAGTGCGGGACATCTTCGACAAGCTGGAAATCGCCGTGATCCTCGTGGGCACCGATAGA<br>CTGGATGCCGTGATCAAGCGGGACGAACAGGTGTACAACCGGTTCAGGGCCTGCCACACAGATTCGGCAAGTTTAGCG<br>GCGAGGACTTCAAGCGGACCGTGGAAATCTGGGAGAGACAGGTGCTGAAGCTGCCTGTGGCCAGCAATCTGTCTGG<br>CAAGGCCATGCTGAAAACCCTGGGAGAAGCCACCGGCGGCTATATCGGACTGCTGGACATGATCCTGAGAGAGAGC<br>GCCATTCGGGCCCTGAAGAAGGGCTGTCTAAGATCGACCTGGAAACCCTGAAAGAAGTGACCGCCGAGTACAAGT<br>GA |
| | TniQ<br>(SEQ ID<br>NO: 1146) | ATGGAAGTGGGCGAGATCAACCCATGGCTGTTCCAGGTGGAACCCTTCGAGGGCGAGAGCATCTCTCACTTTCTGG<br>GCAGATTCAGACGGGCCAACGACCTGACAACAACCGGCCTGGGAAAGCCGCTGGTGTTGGCGGAGCCATCAGCA<br>GATGGGAAGTTCCGGTTCAACCCTCCACCTAGCCGGCAGCAACTGGAAGCCCTGGCCAAAGTCGTGGGAGTCGA<br>TGCCGATAGACTGGCCAGAATGCTTCCTCCTGCTGGCGTGGGCATGAACCTGGAACCTATCAGACTGTGCGCCGCCT<br>GCTACGTGGAAAGCCCTTGTCACAGAATCGAGTGGCAGTTCAAAGTGACCCAGGGCTGCGAGGATCACCACCTGTC<br>TCTGCTGAGCGAGTGCCCTAATTGCGGCGCCAGATTCAAGGTGCCAGCTCTGTGGGTTGACGGCTGGTGCCTGAGAT<br>GCTTCACCCTGTTTGGCGAGATGGTCAAGAGCCAGAACTTCATCGAGAGCCACAACAAGATCTGA |

TABLE 27-continued

| Name/<br>Organism/<br>System<br>ID (T) | | Sequences |
|---|---|---|
| | Cas12k<br>(SEQ ID<br>NO: 1147) | ATGAGCCAGATCACCATCCAGTGCAGACTGCTGGCCTCCGAGAGCACAAGACAGCAGCTGTGGCAGCTGATGGCCG<br>AGAAGAACACCCCTCTGATCAACGAGCTGCTGATGCAGATGGGCAAGCACCCCGAGTTTGAGACATGGCGGCAGAA<br>GGGAAAACACCCCACCGGCGTTGTGAAAGAGCTGTGCGAGCCCCTGAAAACAGACCCCAGATTCATGGGCCAGCCT<br>GCCAGATTCTACACCAGCGCTACCGCCAGCGTGAACTACATCTACAAGAGTTGGTTCGCCTGTCGATGAAGCGGTTCCA<br>GAGCCAGCTGGATGGCAAGCTGAGATGGCTGGAAATGCTGAACAGCGACACCGAGCTGGAAGCCGAAGCGGAGT<br>GTCTCTGGATGTGCTGCAGACAAAGAGCGCCGAGATTCTGGCCCAGTTCGCCGCTCAGAATCCTGCCGAAACACAG<br>CCCGCCAAGGGCAAGAAGGGCAAAAAGTCCCCTACCAGCGACAGCGAGAGAAACCTGAGCAAGAACCTGTTCGAC<br>GCCTACTCCAACACCGAGGACAACCTGACCAGATGCGCCATCTCCTACCTGCTGAAGAACGGCTGCAAGATCAGCA<br>ACAAGGCCGAGAACACCGACAAGTTCGCCCAGCGGAGAAGAAAGGTGGAAATCCAGATCCAGCGGCTGACCGAGA<br>AGCTGGCCGCCAGAATTCCTAAGGGCAGAGATCTGACCGACACACTGCGGCTGGAAACCCTGTTCAACGCCACACA<br>GACCGTGCCTGAGAACGAGACAGAGGCCAAACTGTGGCAGAACATCCTGCTGCGGAAGTCCAGCCAGGTGCCATTT<br>CCTGTGGCCTACGAGACAAAACGAGGACCTCGTGTGGTTCAAGATCAGTTCGGCCGGATCTGCGTGAAGTTCAGCG<br>GACTGAGCGAGCACACCTTCCAGATCTACTGCGACAGCAGACAGCTGCACTGGTTCCAGCGGTTTCTCGAGGACCA<br>GCAGATCAAGAAGGACTCCAAGAACCAGCACAGCAGCGCCCTGTTCACACTGAGAAGCGGCAGAATCAGCTGGCA<br>AGAAGGCCAAGGCAAAGGCGAGCCCTGGAACATCCACCACCTGACACTGTACTGCAGCGTGGACACCAGACTGTG<br>GACCGAAGAGGGCACCAACCTGGTCAAAGAGGAAAAGGCCGAGGAAATCGCCAAGACAATCACCCAGACCAAGAC<br>CAAGGGCGACCTGAACGATAAGCAGCAGGCCCACCTGAAGAGAAAGAGCAGCTCTCTGGCCCGGATCAACAATCA<br>CTTCCCCAGACCTAGCCAGCCTCTGTACAAGGGCCTGAGCCATATCCTCGTGGGAGTGTCCCTGGGACTCGAGAACC<br>CTGCCACAATTGCTGTGGTGGACGGCACCACAGGCAAGGTGCTGACCTACCGGAACATCAAACAGCTGCTCGGCGA<br>GAGCTACAAGCTGCTGAATCGGCAGCGGCAGCAGAAGCACCTCCTGTCTCACGAAAGACACGTGGCCCAGAGAATG<br>AGCGCCCCTAACCAGTTTGGCGATAGCGAGCTGGGCGAGTACATCGATAGGCTGCTGGCCAAAGAAATCATTGCCG<br>TGGCTCAGACCTACAAGGCCGGCAGCATCGTGATCCCCAAGCTGGGAGATATGAGAGAGCAGATCCAGTCCGAGAT<br>CCAGAGCAAGGCCGAACAGAAGTCCGACATCATCGAGGTGCAGCAGAAATACGCCAAGCAGTACCGGACCACCGT<br>GCACCAGTGGTCTTACGGCAGACTGATCAGCAATATCCAGTCTCAGGCCTCTAAGGCCGGAATCGCCATCGAGGAA<br>GGCAAGCAGCCAATCAGAGCCTCTCCACTGGAAAAAGCCAAAGAGCTGGCCATCTCCGCCTACCAGAGCAGAAAA<br>GCCTGA |
| | TracrRNA<br>(SEQ ID<br>NO: 1148) | TTGACAAAATACCGAACCTTAATAATAGAATAGGAATTAACAATAGCGCCGCAGTTCATGTTTTTGATAAACCTCTG<br>TTCGGTGACAAATGCGGGTTAGGTTGACTGTTGTGAGACAGTTGTGCTTTCTGACCCTGGTAGCTGCCTACCTTGAT<br>GCTGCTGTTCCTTGTGAACAGGAATAAGGTGCGCCCCCAGTAATAGAGGTGCGGGTTTACCGCAGTGGTGGCTACC<br>GAATCACCTCCGAGCAAGGAGGAATCCACCTTAATTATTTATTTTGGCGAACCATAAGCGAGGTCAAAAACCCTG<br>GGGTTCTGCCAAAGGTCTAAATCCGTTGTCTAGTCTGTGTTTCAGATGTTAAGATGCTTTGATAATGTTCTCTTCAGA<br>GGGAAATTAGGAGCAAATTTAGGACATCTGCCAAAATTGCTTTTGGAGGTGTCTTTAGATAAGGGTTTGGTCGGGCG<br>GAGTTTT |
| | DR<br>(SEQ ID<br>NO: 1149) | GTTTTAACACCCCTCCCGGAGTGGGGCGGGTTGAAAG |
| | sgRNA<br>(SEQ ID<br>NO: 1150) | TTGACAAAATACCGAACCTTAATAATAGAATAGGAATTAACAATAGCGCCGCAGTTCATGTTTTTGATAAACCTCTG<br>TTCGGTGACAAATGCGGGTTAGGTTGACTGTTGTGAGACAGTTGTGCTTTCTGACCCTGGTAGCTGCCTACCTTGAT<br>GCTGCTGTTCCTTGTGAACAGGAATAAGGTGCGCCCCCAGTAATAGAGGTGCGGGTTTACCGCAGTGGTGGCTACC<br>GAATCACCTCCGAGCAAGGAGGAATCCACCTTAATTATTTATTTTGGCGAACCATAAGCGAGGTCAAAAACCCTG<br>GGGTTCTGCCAAAGGTCTAAATCCGTTGTCTAGTCTGTGTTTCAGATGTTAAGATGCTTTGATAATGTTCTCTTCAGA<br>GGGAAATTAGGAGCAAATTTAGGACATCTGCCAAAATTGCTTTTGGAGGTGTCTTTAGATAAGGGTTTGGTCGGGCG<br>GAGTTTTGAAATCCCGGAGTGGGGCGGGTTGAAAGNNNNNNNNNNNNNNNNNNNNNNNNN |
| | LE<br>(SEQ ID<br>NO: 1151) | AAGGGGAAAGAGGGAACAGGGAATAGGGAACAGGGAATAGGGAACAGGGAACAGGGAATAGGGAATAGGGAAT<br>AGGGTAAAGAGGCAATATTTTTGTACATTAACTAATTATTTGTCAATTTAACAAAATATTGTCACAAAAAATAAAA<br>TTATTGAAACCCTGCTATAACAAGGATCATAGCAGGGTTTAGTTATTATACCTTCTAATCATTTTGTGAAACCTTTTT<br>TAACAAATTAATTGTCAAAAAGGGAAAATTAACAATTTAAGTGTCAATTCCCAAAATCCATGTAAACTACTCTACT<br>TCTGAAAATTTCACACATTAAATGTCACTTTTGATTTATAATATACAAATATGTTCCAATTAAACATCAATGTATATG<br>AGGAATGAAACACCTATAACTCCAGACAACTTAGAAACTGAAAGTGTTACCGCCAAAGATACTCAAATCATTGTGT<br>CGGAACTTTCCGACGAGGCGAAACTAAAAATGGAGATTATT |
| | RE<br>(SEQ ID<br>NO: 1152) | AACACCCCTCCCGGATTGGGGCGGGTTGAAAGACATTTATGCAAGTATAATAAAAAATATCTGGGTGGGTTGAAAG<br>ATCAGTAGGTCGTGGGTTTAACTCTGAAAACACTATATAAATACAGTGTTGCTTGTGATAGTTAGGGACAATTAATT<br>TGTTAACAGTGACACGAATTAGTTAAAATGACATTAATCTGTTAACAGTGACAAATAAATTGTTAATGTACACGAAC<br>GTACAACCTAAAGCCGATGATGAGATTTGAACTCACGACCTACTGATTACGAATCAGTTGCTCTACCCCTGAGCCAC<br>ATCGGCGCATACAGTCTAGTATAATAACATAATTTACTAATGATGGAACAAAATTCTCAAAATAATCTTAAACCTCA<br>ACAATATCAACGCCTCAAAGCCGAAGCAGCCGCACCCTATCGGGGTTTGCGGAAATTTATCTATATCAGCGTCGGTG<br>CATCGGGCTTTATCGGTGCATTCGTCTTCTTCTTTCAAC |
| PVWN01000012/<br>Chlorogloea<br>sp.<br>CCALA 695/<br>T54 | TnsB<br>(SEQ ID<br>NO: 1153) | ATGGCCGACGAGGAATTCGAGCTGACCGAGGAACTGACCCAGGTGCCAGACAACATCCTGCTGGACAAGCGGAAC<br>TTCGTGGTGGACCCCAGCCAGATCATCCTGGAAACCAGCGACAGACAGAAGCTGACCTTCAACCTGATCCAGTGGC<br>TGGCCGAGTCTCCCAACAGAACCATCAAGAGCCAGCGGAAGCAGGCCGTGGCCGATACACTGAATGTGTCCACCAG<br>ACAGGTGGAACGGCTGCTGAAGACGTGACTGAAGCAGTAGCAGCAGCCGGAATCGAGATGCGGAATGCGGCAGCAA<br>GGGCAAGTACCGGGTGTCCAAGTACTGGCAGGACTTCATCAAGACTACGAGAAGTCCCTGAAGGACAAGCAC<br>CCTATCAGCCCCGCCTCTATCGTGCGCGAGCTGAAGGACACGCCATCGTGGATCTGGGACTGAAGCTGGCGACTT<br>CCCTCACCAAGCCACCGTGTACAGAATCCTGGATCCTCTGATGGAACAGCACAAGCGCAAGACCAAAGTGCGGAAT<br>CCTGGCAGCGGCAGCTGGATGACAGTGGTCACAAGAGAGGGCCAGCTGCTGAAAGCCGACTTCAGCAACCAGATC<br>ATTCAGTGCGACCACACCAAGCTGGACATCCGGATCGTGGACATCCACGGCAGCCTGCTGTCTGACAGACCTTGGCT<br>GACCACCATTGTGGACACCTACAGCAGCTGCGTCGTGGGCTTCAGACTGTGGATCAAGCAGCCTGGCAGCACCGAA<br>GTTGCCCTGGCTCTGAGACATGCCATCCTGCCTAAGCACTACCCCGACGACTACCAGCTGAACAAGGCCTGGGAGA<br>TCTGGGCCCTTCCATTCCAGTACTTTTTCCACCGACGGCAGGACTTCAGAAGCAAGCACCTGAAGGCCATCGGC<br>AAGAAACTGGGCTTCCAGTGCGAGCTGAGGGACAGACCTCCTGAAGGCGGCATCGTGAACGGATCTTTAAGACCA<br>TCAACACCCAGGTCCTGAAGGATCTGCCTGGCTACACAGGCGCCAACGTCAAGAAAGACCCGAGAACGCCGAGA<br>AAGAGGCCTGCCTGAAAATCCAGGATCTGGATCGGATCCTGGCCAGCTTCTTCTGCGACATCTACAACACGAGCCT<br>TATCCTAAGCAGCCCTGCGACACCAGATGCGAGAGATGGTTCAAAGGCATGGGCGGCAAGCTGCCTAGGATCCTGG<br>ACGAGAGAGAGCTGGATATCTGCCTGATGAAGGAAGCTCAGAGAGTCGTTCAGGCCCCACGGCTCCATCCAGTTCGA |

TABLE 27-continued

| Name/<br>Organism/<br>System<br>ID (T) | Sequences |
|---|---|
| | GAACCTGATCTACAGAGGCGAGTCTCTGAAGGCCTACCGGGGCGAGTATGTGACCCTGAGATACGACCCCGACCAC<br>ATCCTGACACTGTACGTGTACAGCTGCGAGACAGACGACGGCGTGGAAAACTTCCTGGATTACGCCCACGCCGTGA<br>ACATGGACACCCACGATCTGAGCGTGGAAGAACTGAAGGCCCTGAACAAAGAGCGGAGCAAGGCCGAAGAGAGC<br>ACTTCAACTACGACGCCCTGCTGGCCCTGGGCAAGAGAAAAGAACTGGTGGAAGAGTGCAAAGAGGACAAGAAAG<br>AGAAGCGGCGGCTGGAACAGAAGCGGCTGAGAAGCACCAGCAAGAAAAGCAGCAACGTGATCGAGCTGCGGAAG<br>ATCAGAGCCTCCACCAGCCTGAAGAAGGACGACAGACAAGAGGTGCTGCCCGAGAGAGTGGGCCGCGAGGAAATC<br>AAGATCGAGAGAATCGAGCCCCAGCTGCAAGAGGACATCAGCGTGCAGACCGACACTCAAGAGGAACAGCGGCAC<br>AAGCTGGTGGTGTCCAACCGGCAGAAGAACCTGAAGAAAATCTGGTGA |
| TnsC<br>(SEQ ID<br>NO: 1154) | ATGGCCAGAAGCCAGCTGACCACACAGAGCTTCGTGGAAGTGCTGGCCCCTCAGCTGGACCTGAAGGATCAGATCG<br>CCAAGACCATCGACATCGAGGAACTGTTCCGGACCTGCTTCATCACCACCGACAGAGCCAGCGAGTGCTTCAAGTG<br>GCTGGACGAGCTGCGGATCCTGAAGCAGTGTGGCAGAGTGATCGGCCCCAGAGATGTGGGCAAAAGCAGAGCTGC<br>CCTGCACTACCGGAACGAGGACAAGAAACGGGTGTCCTACGTGAAGGCTTGGAGCGCCAGCAGCAGCAAGAGACT<br>GTTCAGCCAGATTCTGAAGGACATCAACCACGCCGCTCTCCTACCGGCAAGAGACAGGATCTCAGACCTAGACTGGCC<br>GGCAGCCTGGAACTGTTTGGCCTGGAAATCGTGATCATCGACAACGCCGAGAACCTGCAGAAAGAGGCCCTGATCG<br>ATCTGAAGCAGCTGTTCGAGGAATGCCACGTGCCAATCGTGCTCGTCGGCGGAAAAGAGCTGGACGATATCCTGCA<br>GGGCTGCGACCTGCTGACCAACTTTCCCACACTGTACGAGTTCGAGCGGCTGGAATACGAGGACTTCAGAAAGACC<br>CTGAGCACCATCGAGTTCGATGTGCTGGCACTGCCCGAGGCCTCTAATCTCGGCGAGGGCAACATCTTCGAGATCCT<br>GGCCGTGTCCACCAACGCCAGAATGGGCCTGCTGGTCAAGATCCTGACAAAGGCCGTGCTGCACAGCCTGAAGAAC<br>GGCTTCAGCAGAGTGGACGAGAGCATCCTGGAAAAGATCGCCAGCAGATACGCCGGAAGTACATCCCTCTGGAA<br>AACCGGAACCGGAACGGCTGA |
| TniQ<br>(SEQ ID<br>NO: 1155) | ATGGACGAGGACAACAAGATCCTGCCTAAGCTGGCCTACGTGGAACCCTACATCGGCGAGAGCATCAGCCACTACC<br>TGGGCAGACTGCGGAGATTCAAGGCCAACAGCCTGCCTAGCGGCTACAGCCTGGGAAAGATTGCTGGACTGGGCGC<br>CGTGATCAGCAGATGGGAGAAGCTGTACTTCAACCCGTTTCCTACACAGCAAGAGCTGGAAGCCCTGGCCTCTGTTG<br>TGGGAGTGAACGCCGATAGACTGACCGAGATGCTGCCTCTCTAAGGGCATGACCATGAAGCCCAGACCTATCGACT<br>GTGCGGCGCCTGTTATGCCGAGTCTCCCTGCCACAGATTCGAGTGGCAGTTCAAGGACATCATGAAGTGCGACGGCT<br>ACGCCGGCAGAAGGCACAGACACGAACTGAGACTGCTGACCAAGTGCATCAACTGCGAGACACCCTTTCCTATACC<br>TGCCGACTGGATCAAGGGCGAGTGCCCTCACTGTAGCCTGCCTTTCGCCAACATGGCCAAGCGGCAGAGAAGAGAC<br>TGA |
| Cas12k<br>(SEQ ID<br>NO: 1156) | ATGAGCGTGATCACCATCCAGTGCAGACTGGTGGCCGAAGAGGACTTCCTGAGACAGCTGTGGGAGCTGATGGCCG<br>AGAAGAACACCCCTCTGATCAACGAGCTGCTGGCTCAGCTGGGAAAGCACCCTGAGCTGGAAACCTGGCTGGAAAA<br>GGGCAAGATCCCCACAGAGCTGCTGAAGGCCCTGGGCAACGCCCTGAAAAACCCAAGAGCCTTTTGCCGGCCAGCCA<br>GGCAGATTCTACACAAGCGCCATTGCTCTGGTCAACTACGTGTACAAGAGTTGGTTCGCCCTGCAGAAGCGGCGGA<br>AGTACCAGATCGAGGGCAAAGAACGGTGGCTGAAGATGCTGAAGTCCGACCTGGACCTGGAACAAGAGTCCCAGT<br>GTAGCCTGGACGTGATCAGAATCAAGGCCACCGAACTGCTGCAAGTTCACCCCTCAGTTCGACACCAACAACAA<br>GCAGCGCAAGGGGAAGAAGAACAAGAAGGCCAGCAAGACCCAGAAAACCTAGCGTGTTCAAGGTGCTGCTGAACAC<br>CTACGAAGAGACACAGTGCCTGCTGACAAGATGCGCCCTGGCCTACCTGCTGAAGAACAACTGCCAGATCAGCGAG<br>CTGAACGAGAACCTGGAAGAGTTCACCCGGAACCGGCGGAAGAAAGAGATCGAGATCGAGCGGCTGAAGGACCAG<br>CTGCAGAGCAGAATCCCCAAGGGCAGAGATCTGAAGGGCAAGAGTGGCTGAAAATCCTCAAGATCGCCACCGCC<br>AACGTGGCCCAAGGATGAGAATGAAGCCAAAGCCTGGCAGGCCGCTCTGCTGAGAAAGACCAAGAACGTGCCCTTTC<br>CAGTGGACTACGAGAGCAACGAGGACATGACCTGGCTCAAGACGACAAGAACCGGCTGTTCGTGCGGTTCAACG<br>GACTGGGCAAGCTGACCTTCGAGATCTACTGCGACAAGCGGCATCTGCCCTACTTCCAGCGGTTCCTGGAAGATCAA<br>GAGATCAAGCGGAACAGCAAGAACCAGTACAGCAGCAGCCTGTTCACACTGCGGAGCGCCAGAATCTCTTGGCTGC<br>CCGGGAAAGAGAAAGGCGAGGCCTGGAAAGTGAACCAGCTGAACCTGTACTGCAGCCTGGACACCAGAATGTGGA<br>CCACCGAGGGCACAATCCAGGTGGTGGAAGAGAAAGTGATGGCCATTACCGAGACACTGACCAAGACCAAGCAGA<br>AGGACGACCTGAACCACAAGCAGCAGGCCTTCATCACCAGACAGCAGAGACACACTGAACCGGATCACAAACCCCTT<br>TCCACGGCCTTGCAAGCCCACCTATCAGGGCAAGCCTTCTATCCTGCTGGGCGTGTCCTTCGGCCTGGATAAGCCTG<br>CTACAGTGGCCGTGGTGGATGCCGCCAACAAAAAGGTGCTGGCCTACAGAAGCACCAAACAGCTGCTGGGCAAGA<br>ACTACAATCTGCTGAACCGGCAGCGGCAGCAGCAACAGAGACTGAGCCACGAGAGACATATCGCCCAGAAGCAGA<br>ACGCCCCTAACAGCTTTGGCGAGTCTGAGCTGGGCCAGTACGTGGACAGACTGCTGGCTGACGCCATCATTGCCATT<br>GCCAAGACCTACAAGTGGGCAACATCGTGCTGCCCAAGCTGCCGGTACATGAGAGAGCAGATCAGCAGCGAGATCC<br>AGAGCAGAGCCGAGAAAAGTGCCCCGGCTTCAAAGAGGCCCAGCAGAAGTACGCCCAAGAGTACAGAATCAGCGC<br>TGCACCGGTGGTCCTATGCAGGCCGGTTGGAATCCATCAAGAGCCAGGCCGCCAAGGCCGGCATCTCTACAGAGAT<br>TGTGACCCTGCTGACCCGGGGCAGCCCTGAGGAAAAGCTAGAGATCTGGCCGTGTTCGCCTACCAAGAGAGACAG<br>GCCGCACTGATCTGA |
| TracrRNA<br>(SEQ ID<br>NO: 1157) | TTTACTTCCGAACCTTGAAAATATAATATGGATATAACAGCGCCGCAGTTCATGCTCTTTAAAGCCTCTGTACTGTG<br>AATAATCTGGGTTAGTTTGGTGGTTGGAAGACCGTCATGCTTTCTGACCCTGGTAGCTGCCCGCTTCTGATGCTGCTG<br>TCGCCAGACAGGATAGGTGCGCTCCCAGCAATAAGGAGTAAGGCTTTTAGCCATAGTCGTTATTCATAACGGCGTG<br>GATCTCCACAGTGGTGGCTACTGAATCACCCCCTTCGTCGGGGGAACCCTCCCAAATATTTTTGGCAAACCGAAGC<br>GAGGTGAAAACCCTGGAGCTTTGCCAAAATATTGAATCCCTTGTCCAGTATTGGTTTGATTCTTTGGAGGAGTGATG<br>AATCTCCTCACATTAAAGCAGAAAGCGAGTATTTTGACAGGGTTGCCAAAATTGCATCTGGAACCCTGTACTAACA<br>AGGGGTCAGACGGGTGCG |
| DR<br>(SEQ ID<br>NO: 1158) | GTTTCAAAGACCATCCCGGCTGGAGGTAAGTTGAAAG |
| sgRNA<br>(SEQ ID<br>NO: 1159) | TTTACTTCCGAACCTTGAAAATATAATATGGATATAACAGCGCCGCAGTTCATGCTCTTTAAAGCCTCTGTACTGTG<br>AATAATCTGGGTTAGTTTGGTGGTTGGAAGACCGTCATGCTTTCTGACCCTGGTAGCTGCCCGCTTCTGATGCTGCTG<br>TCGCCAGACAGGATAGGTGCGCTCCCAGCAATAAGGAGTAAGGCTTTTAGCCATAGTCGTTATTCATAACGGCGTG<br>GATCTCCACAGTGGTGGCTACTGAATCACCCCCTTCGTCGGGGGAACCCTCCCAAATATTTTTGGCAAACCGAAGC<br>GAGGTGAAAACCCTGGAGCTTTGCCAAAATATTGAATCCCTTGTCCAGTATTGGTTTGATTCTTTGGAGGAGTGATG<br>AATCTCCTCACATTAAAGCAGAAAGCGAGTATTTTGACAGGGTTGCCAAAATTGCATCTGGAACCCTGTACTAACA<br>AGGGGTCAGACGGGTGCGGAAATCCCGGCTGGAGGTAAGTTGAAAGNNNNNNNNNNNNNNNNNNNNNNN |

TABLE 27-continued

| Name/<br>Organism/<br>System<br>ID (T) | | Sequences |
|---|---|---|
| | LE<br>(SEQ ID<br>NO: 1160) | TGCCCGGTTGATTAAAGGAAGAACCGACCTATCAAGCGGACACTAATTTGTCAAAGCGACATCAATTTGACAACGA<br>CGACAAATAATTAGTCAATCGACAAATTTTGTACATTCGCACATTATATGTCGCAATTCTCAAGCCAGGTCGTAACT<br>GCTTTTAAAGCCTGAGAACTCAATCGTGTAACCATCGTAGTCTATTTACCTATAAAAGACAAACTAACTTGATTCGC<br>ATATTGTACGTCGTAAACGTCAGTTTCGCAAATTGATTGTCGTTTATGAAAATTTAGGTGTTTTGCAAATTAGAAGTC<br>GCATTTTTGATAAGATAATGGTACATTAGTACCTTAATTATTTACGAGTGGATTTCACTCTAATGGCAGACGAAGAA<br>TTTGAACTTACTGAAGAATTGACACAAGTTCCGGACAATATTTTACTTGACAAGAGAAATTTTGTCGTAGACCCATC<br>GCAAATTATTCTGGGAAACTTCGGATAGGCAAAAACTGA |
| | RE<br>(SEQ ID<br>NO: 1161) | GTTTCAAAGACCATCCCGGCTGGAGGTAAGTTGAAAGAGGCGTGAGTGGTGAGGTTCAAAAACTATCCGACCAGGG<br>GTATGTTAGAAGAGAATAGCAATTTTTGTTATTGATACTTCACGGATGTATTTTTCAAGGGGAGGGTAGAAAGGCGC<br>ACTTCGTTCGGGATTATCCTAAAGTTTGTCAGTAAATTATAAAAGTAGTGGACTAAACTTCATCTTAAGACAGTCTA<br>CGACATCAATTTGCAAAAACTCAGTGTGATTAAATCACATCATTAAAACTACTAAGGCAACATTAATTTGCGAGTAA<br>CGACACTAATTTGCAGTTGCGACATATAATGTGCAATGTACAAATTTAAGTCGGGATGACTGGATTCGAACCAG<br>CGACCCCTTCGTCCCGAACGAAGTGCGCTACCAAGCTGCGCTACATCCCGCGAAAAAATGCTTTCATTTCACGCCTT<br>TCTATCCTACACCAAACGCACCAATTCCCGCACTTTTAGA |
| NZ_<br>JRFE01000024/<br>Myxosarcina<br>sp. GI1/<br>T55 | TnsB<br>(SEQ ID<br>NO: 1162) | ATGAACAGCGAGAGCACCAGCGAGACAAACAGCAAGCTGGCCATCAGCGACCTGGAAGATGACCGCGAGATCGTG<br>ATCACCAGCCAGCTGGAAGGCAAGGCCAAAGAACGGCTGGAAGTGATCCAGAGCCTGCTGGAACCTTGCGACAGA<br>GCCACATACGGCGAGAGACTTAGAGCTGGCGCCAAGAAACTGGACATCAGCGTCAGAAGCGTGCAGCGGCTGTTCA<br>AGAAGTACCAAGAGCAGGGCCTGACAGCCCTGGTGTCCACCAACAGAGTGGACAAGGGCAACAGACGGATCAGCA<br>GCTTCTGGCAGGACTTCATCGTGACAGCCTACATCCAGGGCAACAAGGGCAGCAAGCGGATGAGCCCTAAACAGGT<br>GGCCATTAGAGTGCAGGCCAAGGCCAGCGAGATCAAGGCACAACAAGGTTCCTAGCTACAAGACCGTGCTGCGGCTG<br>CTGAAGCCCATCCAGAAGAAGAAAGAGCGGACCATCAGAAGCCCTGGCTGGCAGGGAACAACCCTGAGCGTGAAA<br>ACCAGAGATGGCCAGGACATCCAGATCAACCACAGCAATCAAGTGTGGCAGTGCGATCACACCCTGGTGGATGTGC<br>TGCTGGTGGATAGACACGGCGAGTCTGATTGGCAGACCTTGGCTGACCACCGTGGTGGACAGCTGAACAGATGCGT<br>GATGGGCATCAACCTGGGCTTCGATGCCCCTAGCTCTCTGGTGGTTGCTCTGGCCCTGAGACACAGCATCCTGCCTA<br>AGAACTACTCCCAGGATTTCCAGCTGTACTGCGACTGGGGCGTGTTCGGACTGCCTGAGTGCCTGTTTACAGACGGC<br>GGCAAGGACTTCCGGTCCAACCATCTGGAAGAGATCGCCACACAGCTGGGCTTCATCCGGAAGCTGAGAGACAGAC<br>CTAGCGAAGGCGGCATCGTGGAAAGACCCTTCAAGACCCTGAATCAGAGCCTGTTCAGCACCCTGCCTGGCTACAC<br>AGGCAGCAACGTGCAAGGAGGCCTAAGGACGCCGAGAAGGATGCCAGACTGACCCTGAGAGATCTGGAAATGCT<br>GATCGTGCGGTTCATCGTGGACAAGTACAACCAGAGCACAATCGCCGGCAAGGATGAGCAGACCCGGTATCAGAG<br>ATGGGAGGCCGGACTGATCAAGGATCCCAAGATCATCAGCGAGAGAGAGCTGGACATCTGCCTGATGAAGTCTAAG<br>CGGCCGGACAGTGCAGAGAGGCGGCCATCTGCAGTTCGAGAACATCATCTACCGGGGCGAGTACCTGGCCGGCTATG<br>AGGGCGATATTGTGAACGTGCGGTACAACCCCATCAACATCACCACCATCCTGGTGTATCGGCGCGAGCAGGGCAA<br>AGAGGTGTTCCTGACAAGAGCCCACGCTCTCGGATGGGAGACAGAGATCCACAGCCTGTCTGAGGCCAGAGCCAGC<br>GTGAAGACTGAGACAGGCCAAGAAGAAGATCAGCAACGAGTCCATCCACCAAGAGATCCTGCTGAGGGACAGC<br>GCCGTGGATAAGAAGAAGTCCAGAAAGCAGCGGCAGAAAGAGGAACAGAGCTACAAGCTGATCACAAGCCCCAAG<br>GTGGTGGCCCAGGATATCGAGTCTCAAGAGATCGAGCGGGACATCTCCGCCGAGATCGCTGATGTGGAAGTGTGGG<br>ACTTCGACGAACTCGAGGACGAGTGA |
| | TnsC<br>(SEQ ID<br>NO: 1163) | ATGGTCACAGAGGCCAAGGCCATTGCCGACAAGCTGGCCAAGATCGAGCTGGACAAGAGTGGGTGCAGAAAGAG<br>ATCGCCCGGCTGAACCGGAAGTCTACAGTGGCCCTGGAACACATCAAAGAGCTGCACGACTGGCTGGACGGCAAGA<br>GAAAGAGCACAGGTCCTGCAGAATCGTGGGCAAGAGCGAACCGGCAAGCAGTGGCCTGTGAAGCCTACGTGA<br>TGCGGAACAAGCTGAACAAGCCTCCTCAAGAGCGGCAGACCAAGAATCAGATCCCCATCGAGCCCGTGATCATGAT<br>TATGCCTCCACAGAAGTGCGGCGCCAAAGAACTGTTCCGCGAGATCATCGAGTGCCTGAAGTTCAGAGCCGTGAAG<br>GGCACCATCAGCGAGTTCAGATCCAGAGCCATGGACGTGCTGCAGAAATGCCAGGTGGAAATGCTGATCATCGACG<br>AGGCCGACGGCTGAAGCCTGAGACATTTTCCGAAGTGCGGACATCTACGACAAGCTCGAGATCGCCGTGGTGCT<br>CGTGGGCACCCAAAGACTGGATACCGCCGTGAAGAGAGATGAGCAGGTCGAGAACAGATTCCGGGCCAACAGAAG<br>ATTCGGCACCCTGGAAGGCATCAACTTCAAGAAAACCGTCGAGATCTGGGAAGAGAAGATCCTGAAGCTGCCCGTG<br>GCCAGCAACCTGACCAACAAGACCACCTGGAAGATTCTGCTGATCGCCACCGAGGGCTTCATCGGCAGACTGGACG<br>AGATTCTGAGAGAGCCGCTATCGCCAGCCTGTCTCAGGGACACAAGAAGGTGGACCCCAAAATCCTGAAAGAGAT<br>TGCCAGAGAGTACAGCTGA |
| | TniQ<br>(SEQ ID<br>NO: 1164) | ATGAACAACACCAAAGAGGCCCAGCTCTGGCTGTTCCCCGTGGAACCTTCTAATGGCGAGAGCCTGAGCCACTTCCT<br>GGGCAGATTCAGGCGGAGCAACCACCTGTCTCCAAGCGCTCTGGGAGATCTGGCTGGAATTGGCGGAGTGGTGGCC<br>AGATGGGAGAGATTCCACCTGAATCCATTTCCAACCGACAGCAGTTCAGGCCCTGGCCGAAGTGGTGGATGTGG<br>ATAGCAGCACCCTGAGAGAGATGCTGCCTCCTAAAGGCACCGGCATGAAGTGCGACCGGCACAACCTGAAGCTGAT<br>CTCCAAGTGTCCCAACTGCCGGGCCAAGTTCAAGATGCCTGCTCTGTGGGAGTACGGCTGCTGCCACAGATGCAGA<br>CTGCCTTTTGCCGCTATCGCCCAGTACCAGCAGAGCGTGTAA |
| | Cas12k<br>(SEQ ID<br>NO: 1165) | ATGAGCCAGAACGCCATCCAGTGCAGACTGATCGCCCCTGAGACAACCCGTAGACAGCAGTGGCAGCTGATGGCCG<br>AGAAGAACCCCCTCTGATCAACGAGCTGCTGAAGCAGCTGGCCGAGCATCCTGAGCTGGAAACCTGGAAGCGGA<br>AGGGCAAGATCCCTCCTGGCACCGTGAAGAACCTGTGCCAGCCTCTGAGAACCTGTCCTCAGTACATCAACCAGCCT<br>GGCCGGTTCTACAGCAGCGTGATCTCTCTGGCCGAGTACATCTACAGAAGCTGGCTGAAGCTGCAGCGGCGGCTGA<br>TCTTCAGACTGAACGGACAGCAGCGGTGGCTGCAGATGCTGAAGTCCGATGAAGAACTGGTGGCCGAGAGCGGCA<br>GAAGCCTGAAAGAGATTGAGGCCAAGCCAGCAGGGCCCTGGACAGGCTGACAGAGATGGAGGAAAAACCCAGCATCA<br>GCAACCGGCTGTTCGACCTGTACGACGAGACAGAGGCCATCCTGATCCGCAGCGCCATCGTGTACCTGCTGAAGAA<br>CGGCTGCAAGATCAGCAGAAGCCCGAGGATCCCAAGAAGTTCGCCAGACGGCGGAGAAAGACCGAGATCAGAGT<br>GAAGAGACTGCAAGAAGCTGAACGGCAAGGCCCCTCAGGGCAGAGATCTGACAGGCGAGAAATGGCTGAACAC<br>CCTGTTCACCGCCACCAGCCAGGTGCCACAGGATGAAGCCACCAGGTGGCAGGACATTCTGCTGACCAAG<br>AGCAAGCTGGTGCCCTATCCTATCGTGTACGAGAGCAACGAGGACCTGACCTGGTCCAAGAACGAGAGGGGCAGAC<br>TGTGCCGTGAAGTTCAACGGCCTGAGCGACCACACCTTCCAGATCTACTGCACAGACGGCAGCTGAAGATCTTTAA<br>CAGGTTCTACGAGGACCAGCAGATCAAGAAGGCCAGCAAGAACAGCCACAGCAGCGCCCTGTTTACCCTGAGATCT<br>GCCACAATCGCCTGGCAAGAAGGCCAAAGGCAAAGGCCAGCGAGCCCTGGAACGTGGAAGCCGGCTGATCGTACTGCACT<br>TCGACAACCTGCTGCTGACAACCGAGGGCACAGAGGTTGTGCGGCAAGAGAAAGCCGAGGCCATTGCTCAACACACT<br>CACCAAGATCAAAGAAGGGCGACCTGAACCAGAAGCAGCAGGCCTTCATCCGGCGGAAAGAGACAAGCCTGAG<br>CCGGATCAACAACCCATTTCCTCGGCCTAGCAGACCCCTGTACAAGGGCAAGTCCAACATCCTGCTGGGCGTCGCCA<br>TCAGACTGGATAAGCCTGCCACAGTGGCCATCGTGGATGGCGCCACAGATAAGGCTATCGCCTACCTGAGCACCAA<br>ACAGCTGCTGGGCAAGAACTACCATCTGCTGAACCGGAAGAGACAGCAGCAGCACATCCTGTCTCACCAGAGAAAC |

TABLE 27-continued

| Name/<br>Organism/<br>System<br>ID (T) | | Sequences |
|---|---|---|
| | | GTGGCCCAGAGACACCACGCCAACAACAAGTTTGGCGAGAGCGAGCTGGGCCAGTACATCGATAGACTGCTGGCCA<br>AAGCCATCATCCAGCTGGCCAAGGACTACAGAGTGGGCAGCATCGTGGTGCCTTACATGGAAGATACCCGCGAGAT<br>CATCCAGGCCGAGGTGCAGGCTAGAGCCGAGGCTAAGATCCCTGGCTGCATCGAGAAGCAGAAAGAGTACGCCAA<br>GAAGTACCGGACCAACATCCACAAGTGGTCCTACGGCAGGCTGATCGATCTGATCAAGGCCCAGGCCGCCAAGGCC<br>GGAATCGTGATCGAGGAAGCAAGCAGAGCATCCGGGGCGACCCTAAGAAGCAGGCCAAAGAAATTGCCGTGTGC<br>GCCTACCGGGACAGAATCGTGCCTTTCTGA |
| | TracrRNA<br>(SEQ ID<br>NO: 1166) | GAGTGTCAATTTAAGAATTTTCAAGCACATAACTTCTGTACCTCGAAAATTAAATATAATTTTTAATAAATCAAATA<br>TAATTTTTAATAAATCGCGCCGTAGATCATGTTCTTTTAGAACCGCTGAACTATGTTAAATGTGGGTTAGTTTTACTG<br>TCGGCAGGCAGAATGCTTTCTGTCCCTGGTAGCTGTCCGCCCTGATGCTGCCATCGAAAAGATGGGAATAAGGTGCG<br>CCCCCAGCAATAAGTGGTGTAGACGTACTACAGCGATCGCTACCGAATCACCTCCGAGCAAGGAGGAGTCTATCCT<br>CATTTTTTCTCTTTTTTGACGAACCCAAGCGTGGGCAAAATTCTTAGGGGGTTCGACAAAACTGCAAAAGTCAAGCC<br>TGACAAGCTTTTGATACTTTTAACGAAGTGGTTTTTACTGTAATGCAACAAAAAATAGAGAATTCTTTCTTAGGTTTG<br>TCAAAATTGACCCTGGAGATGAGTCTTAATAACTATTTCAGCTTACAGA |
| | DR<br>(SEQ ID<br>NO: 1167) | GTTTCAACGACCACTTTAAGATGGGTATGGTTGAAAG |
| | sgRNA<br>(SEQ ID<br>NO: 1168) | GAGTGTCAATTTAAGAATTTTCAAGCACATAACTTCTGTACCTCGAAAATTAAATATAATTTTTAATAAATCAAATA<br>TAATTTTTAATAAATCGCGCCGTAGATCATGTTCTTTTAGAACCGCTGAACTATGTTAAATGTGGGTTAGTTTTACTG<br>TCGGCAGGCAGAATGCTTTCTGTCCCTGGTAGCTGTCCGCCCTGATGCTGCCATCGAAAAGATGGGAATAAGGTGCG<br>CCCCCAGCAATAAGTGGTGTAGACGTACTACAGCGATCGCTACCGAATCACCTCCGAGCAAGGAGGAGTCTATCCT<br>CATTTTTTCTCTTTTTTGACGAACCCAAGCGTGGGCAAAATTCTTAGGGGTTCGACAAAACTGCAAAAGTCAAGCC<br>TGACAAGCTTTTGATACTTTTAACGAAGTGGTTTTTACTGTAATGCAACAAAAAATAGAGAATTCTTTCTTAGGTTTG<br>TCAAAATTGACCCTGGAGATGAGTCTTAATAACTATTTCAGCTTACAGAGAGAAACTTTAAGATGGGTATGGTTGAAAG<br>NNNNNNNNNNNNNNNNNNNNNNNNN |
| | LE<br>(SEQ ID<br>NO: 1169) | CGCTAGTACATTCCAGCGTCCTATCAACAGAAGTAGAATTCCCTGAATGATGCCACTAATTCCACTATTAATAGGAA<br>CCTCTTCTTTTTGAATAAATATGTACGGTGACTAATTATTTGACATAATGACAAATTGTTGTCATGCAATTCAAAGCT<br>TTATATGCTAGGCATCATAGCATTTTTATTATAATATTTGATTGACTTATATAATGACAAACAAAATGTCGTTTGTTT<br>GCAAAATGACTAATTAGCTGTCGTTTATTGAAAATTCAGTTTTAAAGAAAAGTGACAAGATCTGTGTCACTTTTTTA<br>TTTAAATATAGAATTACATTATGTGTTTTTTAAAAAAAACTAATTTACTAAAATGAATAGTGAAAGCACTTCCGAAAC<br>AAATTCAAAATTAGCTATATCTGATTTGGAAGACGACCGAGAAATAGTCATTACTTCTCAGCTAGAAGGAAAAGCA<br>AAAGAGAGACTGGAGGTCATTCAAAGTTTGCTCGAAC |
| | RE<br>(SEQ ID<br>NO: 1170) | GTTTCAATGACCATTTTTGTGATGGCTTGGGTTGAAAGATAAAGGCTTAGTCATTGTTATTGATGAAGCGGAAGTGCC<br>AACGACCACACGCAAATTTTAATTCTCAATAACTATCGTCTAATTCTCGCTAAGAAACTGAAAGTAATTTTAAAGTC<br>TTGTTCTTTGGTTACTCCAAGTAATTTATTACTTTTAGGCGATCGCCTTGCTTGCCGAGTTTAATTTGTATCAGCAAT<br>TGCTGTATACAGTCTAAAACCAAGTAAATTCGATTAATTATTTTTGTGCGACGCAGTAAGTCGCTTGATTTAAGTGA<br>AAATTTCATGACTGAGGTTATGGATTTCTAGTAGATTTCATCCTACTATTCCCACGTAAAGGAGTCTCGTACTCTGGT<br>CACATTGAAAGTAAATAATGAACTCAATGGAATGCAGACCATGAATGTATCCGAAGGTGGATAACCTCTATCCAGC<br>TAGGGCTAGGGAAAAGTTGGAAGGGTTAATGTAAAT |
| AP018288/<br>Nostoc sp.<br>NIES-4103/<br>T56 | TnsB<br>(SEQ ID<br>NO: 1171) | ATGGACGAGATGCCCATCTTCAACCAGAACGACGAGAGCCTGCTGTTCGAGAACAACGCCGACATCGACGAGATCC<br>AGGACGAGAGTCCAGGAAGCCAACCTGATCTTCCACGAGCTGAGCGCCGAGCCCAAGATCAAGATGGAAGTGA<br>TCCAGGGCCTGTTCGAGCCCTGCGACAGAAAGACATACGCCCAGAAGCTGAGAACAGCCGCCGAGAAGCTGGGAA<br>AGACAGTGCGGACAGTGCAGCGGCTGGTCAAGAAGTATCAGCAGGACGGCCTGAGCGCCATCGTGGACACCCAGA<br>GAAATGACAAGGGCAGCTACCGGATCGACCCCGAGTGGCAGAAGTTCATCATCACCACCTTCAAAGAGGGCAACA<br>AGGGCTCCAAGAAGATGACCCCTGCTCAGGTGGCCATCATGGGAGTGCAAGTTCGGGCTGACAGCTGGGCCTGAAGAA<br>ATACCCCAGCCACATGACCGTGTACCGGGTGCTGAACCCCATCATCGAGCGGCAAGAGCAGAAGCAGAAACAGCG<br>GAACATCGGCTGGCGGGGCTCTAGAGTGTCTCACAAGACCAGAGATGGCCAGACACTGGACGTGCGGTACAGCAAT<br>CACGTGTGGCAGTGCGACCACACCAAGCTGGATGTGATGCTGGTGGACCAGTACGGCGAGCCTCTTGCTAGACCTT<br>GGCTGACCAAGATCACCGACAGCTACAGCCGGTGCATCATGGGAGTGCAGCGTGGGCTTTGATGCCCCTAGCTCTCA<br>GGTTGTGGCCCTGGCTCTGAGATACGCCATCCTGCCTAAGCAGTACAGCGCCGAGTACAAGCTGCTGAGCGAGTGG<br>CGGACATCTGGCATCCCCGAGAACCTGTTTTACCGACGGCGGCAGAGACTTCAGAAGCGAGCACCTGAAGCAGATCG<br>GCTTCCAGCTGGGCTTCGAGTGTCACCTGAGAGACAGACCTAGCGAAGGCGGCATCGAGGAAGAAGCTTCGGAAC<br>AATCAATACCGAGTTCCTGAGCGGCTTCTACGGCTACCTGGGCAGCAACATCCAAGAGAGATCCAAGACCGCCGAG<br>GAAGAGGCCTGTCTGACACTGAGAGAGCTGCATCTGCTCGTCGTGCGCTACATCGTGGATAACTACAACCAGAGGC<br>TGGACGCCCGGACCAAGGACCAGACCAGATTTCAGAGATGGGAGGCCGGACTGCCCGCTCTGCCTAAGATGGTTCG<br>AGAGCGCGAGCTGGACATCTGCCTGATGAAGAAACCCGGCGGAGCATCTACAAAGGCGGCTATCTGAGCTTCGAG<br>AATATCATGTACCGGGGCGCTACCTGGCCGCCTATGCCGGCGAAAACATCGTGCTGACGATATGACCCCAGAGATA<br>TCACCACCGTGTGGGTGACAGAATCGAGAAGGGCAAAGAGGTGTTCCTGTCCGCCGCTCATGCCCTGGATTGGGA<br>GACAGAACAGCTGTCCCTGGAAGAAGCCAAGGCCGCCTCTAGAAAAGTGCGGAGCGTGGGCAAGACCCTGACCAA<br>CAAGTCTATCCTGGCCGAGATCCACGACAGAGACACCTTTATCAAGCAGAAGAAGAAGTCCCAGAAAGAGCGCAA<br>GAAAGAGGAACAGGCTCAGGTCCACAGCGTGTACGAGCCCATCAACCTGAGCAAGACCGAGCCTCTGGAAAACCT<br>GCAAGAGACACCCAAGCCTGAGACACGGAAGCCCCGGGTGTTCAACTACGAGCAGCTGAGACAGGACTACGACGA<br>GTGA |
| | TnsC<br>(SEQ ID<br>NO: 1172) | ATGAAGGACGACTACTGGCAGAAGTGGATCCAGAACCTGTGGGGCGACGAGCCCATTCCTGAAGAACTGCAGCTGG<br>AAATCGAGCGGCTGCTGACACCTAGCGTGGTGGAACTGGAACACATCCAGAAGATCCACGACTGGCTGGACGGCCT<br>GAGACTGTCTAAGCAGTCGCGGCAGAATTGTGGCCCCTCCTAGGACCGGCAAGAGCGTGACATGTGACGTGTACAGA<br>CTGCTGAACAAGCCCCAGAAGAGGCGGCAAGCGGGATATTGTGCCGTGCTGTATATGCAGGTCCCCGGCGATT<br>GCTCTAGCGGAGAACTGCTGGTGCTGATCCTGGAAAGCCTGAAGTACGATGCCACCAGCGGCAAGCTGACCGACCT<br>GAGAAGAAGAGTGCAGAGGCTGCTGAAAGAAACAAGGTGGAAATGCTGATTATCGACGAGGCCAACTTCCTCAA<br>GCTGAACCTGTCAGCGAGATCGCCCGGATCTACAGACCTGCTGAGAATCAGCATCGTGCTCGTGGGCACCGACGGC<br>CTGGACACCCTGATCAAGAAGAGCCCTACATCCACGACCGGTTCATCGAGTGCTACAGGCGTGCCTCTGGTGTCCG<br>AGAAGAATTCCCCGAGCTGGTCAAGATCTGGGAAGAAGAGGTGCTCTGCCTGCCTCCTAGCAATCTGATCCG<br>GAACGAGACACTGCTGCCCCTGTACCAGAAAACCGGCGGCAAGATCGGCCTGGTGGATAGAGTTCTGCGGAGAGCC<br>TCTATTCTGGCCCTGAGAAAGGGCCTGAAGAATATCGACAAGGACACCCTGGCCGAGGTGCTGGATTGGTTCGAATGA |

TABLE 27-continued

| Name/Organism/System ID (T) | | Sequences |
|---|---|---|
| | TniQ (SEQ ID NO: 1173) | ATGGAAATCGGAGCCGAGGAACCCCGGTTCTTCGAGGTGGAACCTCTGAATGGCGAGAGCCTGAGCCACTTCCTGG<br>GCAGATTCAGAAGAGAGAACTACCTGACCAGCAGCCAGCTGGGCAAGCTGACAGGACTGGGAGCCGTGATCAGCA<br>GATGGGAGAAGCTGTACTTCAACCCATTTCCAACCAGCAAGAGCTGGAAGCCCTGGCCACAGTCGTCAGAGTGAA<br>CGCCGATAGACTGACCGAGATGCTGCCTCTGAAGGGCGTGACCATGAAGCCCAGACCTATCAGACTGTGCGCCGCC<br>TGCTATGCCGAGTATCCCTGTCACAGAATCGAGTGGCAGTTCAAGGACAAGATGAAGTCGACCGGCACAACCTGC<br>GGCTGCTGACCAAGTGCATCAACTGCGAGACACCCTTTCCTATACCTGCCGACTGGGTGGAAGGCGAGTGCAGCCA<br>CTGCTTTCTGCCTTTTGCCACCATGGCCAAGCGGCAGAAAAGCCGGTAA |
| | Cas12k (SEQ ID NO: 1174) | ATGAGCGTGATCACCATCCAGTGCAGATGGTGCCGAGGAAGAGACACTGTCTCAGCTGTGGGAGCTGATGGCCG<br>ACAAGAACACCCCTCTGATCAACGAGCTGCTGGCCCAAGTGGGCAAGCACCCCGATTTTGAGACATGGCTGGAACA<br>GGGCAAGATCCCCACAGAGCTGCTGAAAACCCTGGTCAACAGCCTCAAGACCCAAGAGAGATTCGCCGGCCAGCCT<br>GGCAGATTCTACACAAGCGCCATTGCCATCGTGGACTACGTGTACAAGAGTTGGTTCGCCCTGCAGAAGCGGCGGA<br>AGCACCAGATCGAGGGCAAAGAGAGATGGCTGACCATCCTGAAGTCGACCAGCGCTGGAACAAGAGTCCCAGT<br>GCAGCCTGAACGTGATCCGGACAAAGGCCATCGAGATCCTGAGCCAGTTCACCCCTCAGAGCGACCAGAACAAGAA<br>CCAGCGGAAGTCTAAAAAGACCAAGAAGTCCGCCAAGCTGCACAAGAGCAGCCTGTTTCAGATCCTGCTGAACACC<br>TACGAGCAGACCCAGGATCCTCTGACCAGATGTGCCGTGGCCTACCTGCTGAAGAACAACTGCCAGATCTCCGAGC<br>TGCACGAGGACCCCGAGAAGTTCACCAGAAACCGGCGACGAGATCGAGATCGAGCGGCTGAAGGACCAGC<br>TGCAAGGCAGACTTCCCAAGGGCAGAGATCTGACCGGCGAAGAGTGGCTGGAAACACTGGAAATCGCCACCGACA<br>ACGTGCCCCAGAACGAGAATGAAGCCAAGGCCTGGCAAGCCGCTCTGCTGAGAAAATCTGCCGAGGTGCCATTTCC<br>TGTGGCCTACGAGAGCAACGAGGACATGACCTGGCTGAAAAACGATAAGGGCAGACTGTTCGTGCGGTTCAACGGC<br>CTGGGCAAGCTGACCTTCGAGATCTACTGCGACAAGCGGCATCTGCACTACTTCCAGCGCTTTCTGGAAGATCAAGA<br>GATCAAGCGGAACAGCAAGAATCAGTACAGCAGCTCCCTGTTCACCCGCGGAGTGGTAGACTGGCTTGGCTGCCT<br>GGCGAGGAAAAGGCGAGCCCTGGAAAGTGAATCAGCTGCACCTGTACTGCGCCCTGGACACCAGAATGTGGACC<br>ACAGAGGGCACCCAGAAAGTCATCAACGAGAAGTCCATCAAGATCACCGAGACACTGACCAAGGCCAAGCAGAAA<br>GAGGACCTGAACGACAAGCAGCAGGCCCTTCATCACCAGACAGCAGAGCAACCCTGGACCGGATCCACAATCCATTTC<br>CACGGCCTAGCAAGCCCAACTACCAGGGCCAGCCTTCTATCCTCGTGGGCGTGTCCTTTGGCCTGGAAAAGCCTGTG<br>ACAGTGGCCGTGGTGGACGTGGTCAAGAATGAGGTGCTGGCCTACAGAAGCGTGAAGCAGCCTGGGAAAGAAC<br>TACAATCTGCTGAACCGGCAGCGCCAGCAGCAGCAGAGACTGTCTCACGAGAGACACAAGGCCCAGAAGCAGAAC<br>GCCCCTAACAGCTTTGGCGAGTCTGAGCTGGGCCAGTACGTGGCACAGTGCTGGCTGATGCCATTGTGGCTATCGC<br>CAAGAGCTATCAGGCTGGCCGGCATCGTGATCCCCAAACTGCACGACATGAGAGAGCAGATCAGCAGCAGATCCA<br>GAGCAGAGCCGAGAACAAGTGCCCCGGCTACAAAGAGGCCAGCAGAAGTACGCCAAAGAATACCGGATGAGCGT<br>GCACCGGTGGTCCTACGGCAGACTGATCGACAGCATCAAGAGCCAGGCCGCCAAAGTGGGCATCAGCACAGAGAT<br>CGGCACCCAGCCTATCGAGGCAGCCCTCAAGAGAAGGCTCGCGATCTGGCCGTGTTCACCTACCAAGAAAGACAG<br>GCCGCTCTGATCTGA |
| | TracrRNA (SEQ ID NO: 1175) | CTCACTAATCCGAACCTTGAAAATATAATATTTTTATAACAGCGCCGCAGTTCATGCTCTTTTGAGCCAATGTACTGT<br>GAAAAATCTGGGTTAGTTTGGCGGTTGTCAGACCGTCATGCTTTCTGACCCTGGTAGCTGCCCGCTTCTGATGCTGCC<br>ATCTTTAGAATTCTATAGATGGGATAGGTGCGCTCCCAGCAATAGGAAGTAGGCTTTTAGCTGTAGCCGTTATTTAT<br>GACGGTGTGGACTACCACAGTGGTGGCTACTGAATCACCCCCTTCGTCGGGGGAACCCTCCCAAATATTTTTTGGC<br>GAATCAAAGCGGGGTCAAAAACCCTGGAGACTTGCCAAACTCTGAAAACCCTTGTCATGTATTGAATTAAGAAATT<br>AGTGTGTCAACTGATTTATTTTTTCATTGTCATCAAAACCAGCTTTTTAACAGACTTGTCAAATAGACATCTGAAAC<br>GCTTGTATAACAAGGGCCTAAGCGGGAACA |
| | DR (SEQ ID NO: 1176) | GTTTCAACAACCATCCCGGCTAGGGGTGGGTTGAAAG |
| | sgRNA (SEQ ID NO: 1177) | CTCACTAATCCGAACCTTGAAAATATAATATTTTTATAACAGCGCCGCAGTTCATGCTCTTTTGAGCCAATGTACTGT<br>GAAAAATCTGGGTTAGTTTGGCGGTTGTCAGACCGTCATGCTTTCTGACCCTGGTAGCTGCCCGCTTCTGATGCTGCC<br>ATCTTTAGAATTCTATAGATGGGATAGGTGCGCTCCCAGCAATAGGAAGTAGGCTTTTAGCTGTAGCCGTTATTTAT<br>GACGGTGTGGACTACCACAGTGGTGGCTACTGAATCACCCCCTTCGTCGGGGGAACCCTCCCAAATATTTTTTGGC<br>GAATCAAAGCGGGGTCAAAAACCCTGGAGACTTGCCAAACTCTGAAAACCCTTGTCATGTATTGAATTAAGAAATT<br>AGTGTGTCAACTGATTTATTTTTTCATTGTCATCAAAACCAGCTTTTTAACAGACTTGTCAAATAGACATCTGAAAC<br>GCTTGTATAACAAGGGCCTAAGCGGGAACAGAAATCCCGGCTAGGGGTGGGTTGAAAGNNNNNNNNNNNNNNNNNNN<br>NNNNNNN |
| | LE (SEQ ID NO: 1178) | TAGCTGAAAGTTAGGGAAATACGTAAATTATGTCGTTTAGCACTGTCAAATTGGACAATAATTCTTTAAAACTGACA<br>ATAATGATTTAATGGACATGTCGATTAACTAATTATTTGTCGTCTTAACAAAATAATGTCGTCAAAGATAAAATGTT<br>TGAAAACGTTGCTAAATAAGTGTTTGCAGCGTTTTTTAGTATGTCAACAATCAAGACCGAATTTAACATTTTAATTGT<br>CGTATATTAAAATATTCACAAATTTTATGTCGTTTTTTCAGATTTGAGTTTTCCAAATTTTTTGGAATGTATAACAAA<br>TTAGTTGTCGCTTTTTAGCAAAAATAGTGCTATTATAATATTATTTAGTATATATGTACTAAATAATACATTCTCATA<br>CCAAAAAGTTACTACTTCCATTGACGGGTCAACCGCTTTAGGAAGATTGGATGTTAGCGCACAATAGCGAGTTTGAT<br>ATTACTGTTTTGAGCATGAATCAAGTTTTCCTATG |
| | RE (SEQ ID NO: 1179) | GTTTCAACAACCATTTAAGCTAAGCAGGTGTTGCAAAAATAAGTATATAGAGACTATTTACTTGCACTAACTAGGCT<br>TTAGAATTGTTGAAGGGTATAACTGAGTTATTAGGAGGGTTGAAAGGAGCGCTGCGATCGAACAAAATCAAAGTC<br>AGTGGTTAAGCATAATCAACAATTCAATGACATTAATGTGTTAACAGTTGACTAAGTTAAATCGATGACATTAATTT<br>GTTAAAAGCGACGCTAATTTGTTAATAACGACAATAATCTGTTAACAACGACAAATAATTAGTTAATCGACAGGAC<br>ATATGGAGATAGGGAACTCGAATCCCTGACCTCTGCGGTGCGATCGCAGCGCTCTACCAGCTGAGCTAATTCCCCT<br>TAAAAGTGCTGAGTCTTGCTAACTCAACGCACTACTACAATATAATATTTTAACATTCTCCTGCTGTAGGCTGAGAC<br>TCTTTTTGTAAAAGACTTCTTGTACTCGTTCAAGTTCTA |
| AP018318/<br>Nostoc sp.<br>HK-01/<br>T57 | TnsB (SEQ ID NO: 1180) | ATGCCCGACAAAGAGTTTGGACTGACCGGCGAGCTGACCCAAGTGACCGAGGCCATCTTTCTGGGCGAGAGCAACT<br>TCGTGGTGGACCCTCTGCACATCATCCTGGAAAGCAGCGACAGCCAGAAGCTGAAGTTCCACCTGATCCAGTGGCT<br>GGCCGAGTCTCCCAACAGACAGATCAAGAGCCAGCGGAAGCAGGCCGTGGCTGATACACTGGGAGTGTCCACCAG<br>ACAGGTGGAAAGACTGCTGAAAGAGTACAAGGAGGACCGGCTGACCGAGCAGAACACTGGCGTGCAGGAGTTGACAA<br>GGGCCAGTACAGAGTGTCCGAGTACTGGCAAGAGTACATCAAGACACCTACGAGCAACAGCCTGAAAGAAAAGCA<br>CCCTATGAGCCCCGCCAGCGTCGTGCGGGAAGTGAAAAGACACGCCATCGTGGATCTGGGCCTCGAGCAGGGCGAT<br>TATCCTCATCCTGCCACCGTGTACCGGATCCTGAATCCTCTGATCGAGCAGCAGAAACTGAAGAAGAAGATCAGAA<br>ACCCCGGCAGCGCAGCTGGCTGACCGTGGAAACAAGAGATGGCAAGCAGCTGAAGGCCGAGTTCAGCAACCAGA<br>TCATCCAGTGCGACCACACCGAGCTGGACATCCGGATCGTGGACAACAATGGCGTGCTGCTGCCCGAAAGACCTTG |

TABLE 27-continued

| Name/<br>Organism/<br>System<br>ID (T) | Sequences |
|---|---|
| | GCTGACAACCGTGGTGGATACCTTCAGCAGCTACGTGCTGGGCTTTCACCTGTGGATCAAGCAGCCTGGAAGCGCC<br>GAAGTTGCCCTGGCTCTGAGACACAGCATCCTGCCTAAGCAGTACAGCCACGACTACGAGCTGAGCAAGCCTTGGG<br>GCTACGGCCCTCCATTCCAGTACTTTTTCACCGACGGCGGCAAGGACTTCAGATCCAAGCACCTGAAAGCCATCGG<br>CAAGAAACTGGGATTTCAGTGCGAGCTGCGGGACAGACCTAATCAAGGCGGCATCGTGAACGGATCTTCAAGACCA<br>TCAACACACAGGCCCTGAAGGACCTGCCTGGCTACACAGGCAGCAACGTGCAAGAGAGGCCTGAGAACGCCGAGA<br>AGAAGCCTGCCTGACCATCCAGGACATCGACAAAGTGCTGGCCGGCTTCTTCTGCGACATCTACAACCACGAGCC<br>TTATCCTAAGGACCCCAGAGACACCAGATTCGAGCGGTGGTTCAAAGGCATGGGCGGCAAGCTGCCTGAGCCTCTG<br>GATGAGAGAGAGCTGGATATCTGCCTGATGAAAGAAACCCAGAGAGTGGTGCAGGCCCACGGCAGCATCCAGTTTG<br>AGAACCTGGTGTACAGAGGCGAGAGCCTGAGAGCCTACAAGGGCGAGTATGTGACCCTGAGATACGACCCCGACC<br>ACATCCTGACACTGTACGTGTACAGCTGCGACGCCAACGACGACCTGGGCGATTTTCTGGGATATGTGCACGCCGTG<br>AACATGGACACCCAAGAGCTGTCCCTGGAAGAACTGAAGTCCCTGAACAAAGAGCGGAACAAGGCCCTGAGAGAG<br>CACTGCAATTACGACGCCCTGCTGGCCCTGGGCAAGAGAAAAGAGCTGGTCAAAGAGCGCAAGCAAGAGAAGAA<br>GAGATCCGGCAGGCCGAACAGCAGAGGCTGAGAAGCGGCAGCAAGAAAAACTCCAACGTGGTGGAACTGAGAAA<br>GAGCCGGGCCAAGAACTACCTGCGGAACAACGAGCCTATCGAGGTGCTGCCAGAGCGGGTGTCCAGAAGAGAT<br>CCAGGTGCAGAAAACCGAGGTGCAGATCGAGGTGTCCGAACAGGCCGACAACCTGAAGCAAGAACGGCACCAGCT<br>CGTGATCAGCAGACGGAAGCAGAACCTGAAAAACATCTGGTGA |
| TnsC<br>(SEQ ID<br>NO: 1181) | ATGGCTCAGTCCCAGCTGGCCATCCAGCCTAACGTGGAAGTTCTGGCCCCTCAGCTGGACCTGAACAACCAGCTGGC<br>TAAAGTGATCGAGATCGAGGAAATCTTCAGCAACTGCTTCATCCCCACCGACCGGGCCAGCGAGTACTTCAGATGG<br>CTGGACGAGCTGCGGATCCTGAAGCAGTGTGGCAGAGTTGTGGGCCCCAGAGATGTGGGCAAGAGCAGAACAAGC<br>GTGCACTACAGAAGAGGACCGGAAGAAAGTGTCCTACGTCAGAGCTTGGAGCGCCAGCAGCAGCAAGAGACTG<br>TTCAGCCAGATTCTGAAGGACATCAACCACGCCGCTCCTACCGGCAAGAGAGGATCTCAGACCTAGACTGGCCG<br>GCAGCCTGGAACTGTTCGGAATCGAGCAAGTGATCGTGGACAACGCCGACAACCTGCAGAGAGGCTCTGCTGGA<br>TCTCAAGCAGCTGTTCGACGAGAGCAACGTGTCCGTGGTGCTCGTTGGAGGCCAAGAGCTGGACAAGATCCTGTAC<br>GACTTCGACCTGCTGACCAGCTTTCCCACACTGTACGAGTTTGACCGGCTGGAACAGGACGACTTCCTGAAACCCT<br>GAGCACCATCGAGTTCGACGTGCTGGCTCTGCCTGAGGCCAGCAATCTGTGCAAGGGCATCACCTTCGAGATCCTGG<br>CCGAGACAACAGGCGGCAGAATGGGCCTGCTGGTTAAGATCCTGACCAAGGCCGTGCTGCACAGCCTGAAGAATGG<br>CTTCGGCAGAGTGGACCAGGGCATCCTGGAAAAGATCGCCAACAGATACGGCAAGCGGTACATCCCTCCTGAGAAC<br>CGGAACAAGAACAGCTGA |
| TniQ<br>(SEQ ID<br>NO: 1182) | ATGGCCAGAGACACCTTTCCACCTAAGATCGAGATCCGCATCCACGACAACCACGAGGCCCTGCTGAGACTGGGCT<br>ACGTGGACCCTTATGAGGGCGAGAGCATCAGCCACTACCTGGGCAGACTGCGGAGATTCAAGGCCAACAGCCTGCC<br>TAGCGGCTACAGCCTGGGAAAGATCGCCGGAATTGGCGCCGTGACCACCAGATGGGAGAAGCTGTACTTCAACCCA<br>TTTCCGAGCAACAAAGAGCTGGAAGCCCTGGGCAAGCTGATCTGCCTGCCTACCAACCGGATCTACGAGATGCTGC<br>CTCCTAAGGGCGTGACCATGAAGCCCAGACCTATCAGACTGTGCGCCGCCTGTTATGCCGAGGTGCCCTGTCACAGA<br>ATCGAGTGGCAGTACAAGGACAAGATGAAGTGCGACCGGCACAACCTGCGGCTGCTGACCAAGTGCACCAACTGC<br>GAGACAACATTCCCCATTCCAGCCGACTGGGTGCAGGGCGAATGCCCTCACTGCTTTCTGCCCTTTCCAATGATGGT<br>CAAGCGGCAGCGGCAGCTGAGCAACTAA |
| Cas12k<br>(SEQ ID<br>NO: 1183) | ATGAGCATCATCACCATCCAGTGCCGGCTGGTGGCCGAGGAAGAAACACTGAGACAGCTGTGGGAGCTGATGACCG<br>ACAAGAACACCCCTCTGGTCAACGAGCTGCTGGCCCAAGTGGGAAAGCACCCCGATTTCGAGACATGGCTGGAAAA<br>GGGCAAGATCCCCACAGAGCTGCTGAAAACCCTGGTCAACAGCCTCAAGACCCAAGAAAGATTCGTGGGCCAGCCT<br>GGCCGGTTCTACACATCTGCTATTGCCCTGGTGGACTACGTGTACAAGAGTTGGTTCGCCCTGCAGAAGCGGCGGAA<br>GAGACAGATCGAGGGCAAAGAGAGATGGCTGACCATCCTGAAGTCCGACATCCAGATCGAGCAAGAGAGCCAGAG<br>CACCCTGAACGTGATCAGGACCAAGGCCACCGAGATCCTGACCAAGTTCACCCCTCAGAGCGAGCAGAACCACAAC<br>CAGAGAAAGAGCAAGCGGACCAAGAAGAAGTCCACCAACAGCAAGAAGTCTAGCCTGTTCCAGATCCTGCTGAAC<br>ACCTACGAGGAAACCCAGGACACCCTGACCAGATGTGCCCTGGCCTACCTGCTGAAGAACAACTGCCAGATCAGCG<br>AGCTGGACGAGGACCCCGAGGAATTCACCAGAAAGAAGCGCAAGAAAGAGATCGAGATCCAGCGGCTGAAGGACC<br>AGCTGCAGAGCAGAATCCCCAAGGGCAGAGATCTGACCGGCGAAGAGTGGCTCGAGACACTGGAACTGGCCAGAG<br>CCAACGTGCCCCAGAATGAGAAAGAGGCCAAAGCCTGGCAGGCCGCTCTGCTGAGAAAAGCGCCGACGTGCCAT<br>TTCCTGTGGCCTACGAGAGCAACGAGGACATGACCTGGTGGCAGAACGATAAGGGCAGACTGTTCGTGCGGTTCAA<br>CGGGCCTGGGCAAGCTGACCTTCGAGATCTACTGCGACAAGCGGCATCTGCACTACTTCAAGCGGTTTCTCGAGGACC<br>AAGAGATCAAGCGGAACTCCAAGAACCAGTACAGCAGCAGCCTGTTCACCCTGAGATCCGGCAGGCTTTCTTGGAG<br>GCCTGGCCAGGAAAAGGCGAGCCCTGGAAAGTGAATCAGCTGCACCTCCATTGCGCCCTGGCCACCAGAATGTGG<br>ACAACCGAGGGAACACAGCAGGTCGTGAACGAGAAACCACCAAGATCACCAAGCACTGACCCAGGCCAAGCAG<br>AAGAACGAGCTGAACGAAAAGCAGCAGGCCTTCATCACCCGGCAGCAGAGCACACTGGACCGGATCAACAACCCA<br>TTTTCCACGGCCTAGCAAGGCCAACTACCAGGGCAGTCTAGCATCCTCGTGGGCGTGTCCTTTGGCCTGGAAAAGCC<br>TGTGACAATCGCCGTGGTGGACGTGGTCAAGAATGAGGTGCTGGCCTACAGAAGCGTGAAACAGCTGCTGGGCAAG<br>AACTACAATCTGCTGAACCGGCAGCGGCAGCAGCAACAGAGACTGTCTCACGAGAGACACAAGGCCCAGAAACAG<br>AACGTGCCCAACAGCTTCGGCGAGTCTGAGCTGGGCCAGTACGTTGACAGACTGCTGGCCGACGCCATCATTGCCA<br>TTGCCAAGACATACCAGGCCGGCAGCATCGTGATCCCCAAGCTGAGAGACATGAGAGAGCAGATCAGCAGCGAGA<br>TTCAGAGCAAGGCCGAGAAGAAGTGCCCCGGCTACAAAGAGGCCCAGCAGAAATACGCCAAAGAATACCGGATGA<br>CCATCCACAGATGGTCCTACGGCAGACTGATCGAGAGCATCAAGTCCCAGGCCGCCAAGGCCGGAATTCCTCAGA<br>GATTGGCACCCAGCCTATCCGGGGCAGCCCTCAAGAAAGGCTAGAGATCTGGCCGTGCTGGCTTATCAAGAAGA<br>CAGGTGGCCGTGATCTGA |

TABLE 27-continued

| Name/<br>Organism/<br>System<br>ID (T) | | Sequences |
|---|---|---|
| | TracrRNA<br>(SEQ ID<br>NO: 1184) | TTCACTAATCCGAACCTTGAAAATATAATATTTTTATAACAGCGCCGCAGTTCATGCTTTTTTGAGCCAATGTACTGT<br>GAAAAATCTGGGTTAGTTTGGCGGTTGGAAGACCCTCATGCTTTCTGACCCTGGTAGTTGCCCGCTTCTGATGCTGC<br>CATCTGTAGAATTCTATAGATGGGATAGGTGCGCTCCCAGCAATAAGGAGTAAAGCTTTTAGCTGTAGCCGTTATTT<br>ATAACGGTGTGGATTACCACAGGGTGGCTACTGAATCACCCCCTTCGTCGGGGGAACCCTCCCAAATATTTTTTGG<br>CAAATCGAAGCGGGGTCAAAAACCCTGGGGACTTGCCAAAGTCGGAAAACCCTTGTCCTGTGTTGAATAAAGAAGT<br>TATCGCGTTAATTGATTTACTCTTTTTATTGTCAGCAGAAGCAGCTTTTTCATAGACTTGTCAATTAGACATCTGAAA<br>AGCTTGTATAACAAGGCTCTAGGCGGGAAC |
| | DR<br>(SEQ ID<br>NO: 1185) | GTTTCAACAACCATCCCGGCTAGGGGTGGGTTGAAAG |
| | sgRNA<br>(SEQ ID<br>NO: 1186) | TTCACTAATCCGAACCTTGAAAATATAATATTTTTATAACAGCGCCGCAGTTCATGCTTTTTTGAGCCAATGTACTGT<br>GAAAAATCTGGGTTAGTTTGGCGGTTGGAAGACCCTCATGCTTTCTGACCCTGGTAGTTGCCCGCTTCTGATGCTGC<br>CATCTGTAGAATTCTATAGATGGGATAGGTGCGCTCCCAGCAATAAGGAGTAAAGCTTTTAGCTGTAGCCGTTATTT<br>ATAACGGTGTGGATTACCACAGGGTGGCTACTGAATCACCCCCTTCGTCGGGGGAACCCTCCCAAATATTTTTTGG<br>CAAATCGAAGCGGGGTCAAAAACCCTGGGGACTTGCCAAAGTCGGAAAACCCTTGTCCTGTGTTGAATAAAGAAGT<br>TATCGCGTTAATTGATTTACTCTTTTTATTGTCAGCAGAAGCAGCTTTTTCATAGACTTGTCAATTAGACATCTGAAA<br>AGCTTGTATAACAAGGCTCTAGGCGGGAACGAAATCCCGGCTAGGGGTGGGTTGAAAGNNNNNNNNNNNNNNNNNN<br>NNNNNNN |
| | LE<br>(SEQ ID<br>NO: 1187) | TTTCAAATTCACTTAATTAAACCTGTTGAACAACCACAATTGCTAAATGCGATCAGGCAAATTTTGGCTAACTTAGA<br>TTAATTCTTAATTAACGTGTACATTCGCACATTATATGTCGCAATTCGCAAAAAACGACATGAGCGTCTTTATCATCT<br>AAAACGCTTATCATATAAAAGCTTTCAGGACATTGTTGACTAAAAATACAAAATTCCTTAATTCGCACATTAAATGTC<br>GTTAGAACTGAAATTTGCAAATTAATGTCGTTTATTTAAATTTTGCCACATTGCAAATTCAATGTCGCATTTTCTTTA<br>GTTAATGGTACATTAATACTACCAATAACTACATTCTCCTTGCTTAAATGCCAGACAAAGAATTTGGATTAACCGGA<br>GAATTGACACAAGTTACGGAAGCTATTTTCCTTGGTGAAAGTAATTTTGTGGTCGATCCATTACACATTATTCTGGA<br>ATCCTCAGATAGCCAGAAACTCAAATTTCATCTCAT |
| | RE<br>(SEQ ID<br>NO: 1188) | AGTTTCAACAACCGGCTAGGGGTGGGTTGAAAGCACCCGTAAGCACTCCACTTACATCTGAGTTGCTTATCAGGGTTT<br>CAACAACCATCCCGGTTAGGGGTGGGTTGAAAGGACAATAATTATTTAATAAGCCACAAGCTTTCGCAGGGTTCAA<br>CAAATATTGAGGTTATGGCAGTTTTGCAAAAACAAGCATATAGAGATTATTTATTCGCATTAACCAGGTTTTAAAAT<br>AGTTAAAGGGTATACATGAATTATTAGGAGGGTTGAAAGGAGCGCTGCGATCGGACAAAATTCAATGAGGAAATA<br>ATTCGCTTGCGGTAAACTTGACAGCTAATGACTAAACAATACGACGTTAATTTGCGAAACGTTAATATAACCGAATT<br>AGTGGCACGAATTAGGGAAAGCGACATTAATGTGCAAACAACGACACCAATTTGCGAAGAACGACATATAATGTGC<br>GAATGTACAGTACAAATGGAGAATAGGGAACTCGAATCCCTGACCTCTGCGGTGCGATCGCAGCGCTCTACCAACT<br>GAGCTAATTCCCCTTAAAATGGTTGTTGCTGAGTTAATCAAATTACTAGCAATTCAATCAACGCTC |
| CP000117/<br>Trichormus<br>variabilis<br>ATCC 29413/<br>T58 | TnsB<br>(SEQ ID<br>NO: 1189) | ATGCTGGACGACCCCGACAAGGGCAATCAAGAGCCTGAGCACACGAGATCGTGACCGAGCTGAGCCTGGACGAA<br>CAGCATCTGCTGGAAATGATCCAGAAGCTGATCGAGCCCTGCGACCGGATCACATACGGCGAGAGACAGAGAGAG<br>GTGGCCGGCAAGCTGGGAAGTCTGTGCGGACAGTTCGGCGGCTGGTCAAGAAGTGGGAGCAAGAAGGACTGACA<br>GCCCTGCAGACAGCCACCAGAACCGATAAGGGCACCCACAGAATCGACAGCGACTGGCAGGACTTCATCATCAAG<br>ACCTACAAAGAGAACAACAAGGACGGCAAGCGGATGAGCCCCAAACAGGTGGCACTGAGAGTGCAGACCAAGGCC<br>GAAGAACTGGGCCAGCAGAAGTACCCCAGCTACCGGACAGTGTACAGAGTGCTGCAGCCCATCATCGAGCAGAAA<br>GAGCAAAAAGAGGGCATCAGACACAGAGGCTGGACAGGCTCTAGACTGAGCGTGAAAACCAGAGATGGCAAGGAC<br>CTGTTCGTGGAACACAGCAACCACGTGTGGCAGTGCGACCACACAGAGTGGATCGTCTGCTGCTGGTGGATCAGCAG<br>GCGAGCTGCTTTCTAGACCCTGGCTGACCATCGTGGTGGACACCTACTCCAGATGCATCATGGGCATCAACCTGGGC<br>TTCGACGCCCTAGCTCTCAAGTGATTGCTCTGGCCCTGCGGCACGCCATCCTGCCTAAGAGATACGGCTCTGAGTA<br>CGGCCTGCACGAGGAATGGGCACCTATGGAAAGCCCGAGCACTTCTACACCGACGGCGGCAAGGACTTCAGAAG<br>CAACCATCTGCAGCAGATTGGCGTGCAGCTGGGCTTTGTGTGTCACCTGAGAGACAGGCCTAGCGAAGGCGGCATC<br>GTGGAAAGACCTTTCGGCACCTTCAACACCGACCTGTTCAGCACCCTGCCTGGCTACACAGGCAGCAACGTGCAAG<br>AGAGGCCTGAGCAGGCCGAGAAAGAGGCCTGTATCACCCTGAGAGAGCTGGAAAGACTGCTCGTGCGTACATCGT<br>GGACAAGTACAACCAGAGCATCGACGCCAGACTGGGCGATCAGACCCGGTATCAGAGATGGGAGGCCGGACTGAT<br>CGTGGCCCCTAACCTGATCAGCGAGGAAGAACTGCGGATCTGCCTGATGAAGCAGACCCCGGCGGAGCATCTACAGA<br>GGCGGCTATGTGCAGTTCGAGAACCTGACCTACCGGGCGAAAATCTGGCCGGATATGCCGGCGAGAACGTGGTGC<br>TGAGATACGACCCCAAGGACATCACCACACTGCTGGTGTACCGGCAGAAGGGAAATCAAGAAGAGTTCCTGGCCAG<br>AGCCTACGCTCAGGACCTGGAAACAGAGGAACTGTCTGTGGACGAGGCCAAGGCCATGAGCAGAAGAATCAGACA<br>GGCCGAAAGGCCATCAGCAACCGGTCTATTCTGGCCGAAGTGCGGGACCGCGAGACATTCGTGAACCAGAAAAA<br>GACCAAGAACAGCGCCAGAAGGCCGAGCAGACAATCGTGCAGAAAGCCAAGAAACCCGTGCCTGTGAACCCGA<br>GGAAGAGATCGAAGTCGCCTCCGTGGATAGCGAGCCCGAGTATCAGATGCCCGAGGTGTTCGACTACGAGCAGATG<br>CGCGAGGACTACGGCTGGTAA |
| | TnsC<br>(SEQ ID<br>NO: 1190) | ATGACAAGCAAGCAGGCCCAGGCTGTTGCTCAGCAGCTGGGAGACATCCCCGTGAACGACGAGAAGATCCAGGCC<br>GAGATCCAGCGGCTGAACAGAAAGAGCTTCATCCCTCTGGAACAGGTGCAGATGCTGCACGACTGGCTGGACGGCA<br>AGAGACAGAGCAGACAGTCTGGCAGAGTCGTGGGCGAGAGCAGAACCGGCAAGACCATGGGCTGTGACGCCTACA<br>GACTGCGGCACAAGCCTAAGCAAGAGCCCGGCAGACCTCCTACAGTGCCCGTGGCCTATATCCAGATTCCTCAAGA<br>GTGCGGCGCCAAGAACTGTTCGGCGTGCTGCTGGAACACCTGAAGTACCAGAATGACAAGCAAGGGCACCGGCCGAG<br>ATTAGAGACAGAACCCTGCGGGTGCTGAAAGGCTGCGGAGTGGAAATGCTGATCATCGACGAGGCCGACCGGCTG<br>AAGCCTAAGACATTTGCCGAGGTGCCCGACATCTTCGACAAGCTGGAAATCGCCGTGATCCTCGTGGGCACCGATA<br>GACTGGATGCCGTGATCAAGCGGGACGAACAGGTGTACAACCGGTTCAGAGCTGCCACAGATTCGGCAAGTTTAG<br>CGGCGACGAGTTCAAGAAAATCGTGGACATCTGGGAGAAGAAGGTGCTGCAGCTGCCTGTGGCCAGCAACCTGAGC<br>AGCAAGACAATGCTGAAAAACCCTGGGCGAGACAACCGGCGGCTATATCGGACTGCTGGACATGATCCTGAGAGAG<br>AGCGCCATCAGAGCCCTGAAGAAGGCCTGAGAAAGGTGGACCTGGCCACACTGAAAGAAGTGACCGAAGAGTAC<br>AAGTGA |

TABLE 27-continued

| Name/<br>Organism/<br>System<br>ID (T) | | Sequences |
|---|---|---|
| | TniQ<br>(SEQ ID<br>NO: 1191) | ATGGAAGTGCCCCAGATCCAGCCTTGGCTGTTCCAGATCGAACCCCTGGAAGGCGAGAGCCTGTCTCACTTCCTGGG<br>CAGATTCAGACGGGCCAACGATCTGACACCAACCGGCCTGGGAAAAGCCGCTGGACTTGGCGGAGCTATTGCCAGA<br>TGGGGAGAAGTTCCGGTTCAACCCTCCACCTAGCCGGCAGCAACTGGAAGCCCTGGCCAATGTCGTGGGAGTCGATG<br>CCGATAGACTGGCCCAGATGCTTCCTTCTGCTGGCGTGGGCATGAAGATGGAACCCATCAGACTGTGCGCCGCCTGC<br>TATGCCGAATCTCCCTGTCACAAGATCGAGTGGCAGTTCAAAGTGACCCGGGGCTGCGCCAGACACAAGATCACAC<br>TGCTGAGCGAGTGCCCCAACTGCAAGGCAGATTCAAGGTGCCAGCTCTGTGGGTGGACGGCTGGTGCAACAGATG<br>CTTTCTGAGATTCGAGGAAATGGCCAAGTACCAGAAAGGCCTGTGA |
| | Cas12k<br>(SEQ ID<br>NO: 1192) | ATGGAGCCAGATCACCATCCAGTGCAGACTGGTGGCCAGCGAGCCTTCTAGACACCAGCTGTGGAAGCTGATGGTGG<br>ACCTGAACACCCCTCTGATCAACGAGCTGCTGGTGCAGGTTGCCCAGCATCCTGAGTTTGAGACATGGCGGCAGAA<br>GGGCAAGCACCCCGCCAAGATTGTGAAAGAGCTGTGCGAGCCCCTGCGGACAGACCCCAGATTCATTGGACAGCCC<br>GGCAGATTCTACACCAGCGCCATTGCCACCGTGAACTACATCTACAAGAGTTGGTTCGCCCTGATGAAGCGGAGCC<br>AGTCTCAGCTGGAAGGCAAGATGCGTTGGTGGGAGATGTGAAGTCCGACGCCGAGCTGGTGGAAGTGTCTGGCGT<br>GACACTGGAAAGCCTGAGAACAAAGGCCGCCGAGATCCTGAGCCAGTTTGCCCCTCAGCCTGACACCGTTGAAGCC<br>CAGCCTGCCAAGGGCAAGAAGCGGAAAAAGACCAAGAAGTCTGACGGCGACTGCGCCGAGAGAACACTGAGAGA<br>GAGATCCATCAGCGACTACCTGTTCGAGGCCTACCGGGACACCGAAGAGATTCTGACCAGATGCGCCATCAACTAC<br>CTGCTGAAGAACGGCTGCCAAGATCAGCAACAAAGAGGAAAACGCCGAAGAGTTCGCCAAGCGGCCGGAGAAAGCTG<br>GAAATCCAGATCGAGCGGCTGCGCGAGAAGCTGGAAGCCAGAATTCCCAAGGGCAGAGATCTGACCGACGCCAAG<br>TGGCTGGAAACCCTGCTGCTGGCCACACTGAACGTGCCAGAGAATGAGGCCGAGGCAAGAGCTGGCAGGACAGC<br>CTGCTGAAAAAGTCCATCACCGTGCCTTTCCAGTGGCCTACGAGACAAACGAGGACATGACCTGGTTCAAGAACG<br>AGCCGGGCAGAATCTGCGTGAAGTTCAGCGACTGGCGAGCACACCTTCCAGGTGTACTGCGACAGCAGACAGCT<br>GCAGTGGTTCCAGCGGTTCCTTGAGGACCAGCAGATCAAGCGGAACAGCAAGAACCAGCACAGCAGCAGCCTGTTC<br>ACCCTGAGATCCGGAAGAATCGCCTGGCAAGAAGGCGAGGGCAAGAGCGAGCCCTGGAAAGTGAACCGGCTGATC<br>CTGTACTGCAGCGTGGACACAAGACTGTGGACAGCCGAGGGCACCAATCTCGTGCGGGAAGAGAAGGCCGAGGAA<br>ATCGCCAAGGCTATCCGCCAGACAAAGGCCAAGGGAAAGCTGAACGACAAGCAGCAGGCCCACATCAAGAGAAAG<br>AACAGCTCCCTGGCCAGAATCAACAATCTGTTCCCCAGACCTAGCAAGCCCCTGTACAAGGGCCAGAGCCATATCC<br>TCGTGGGAGTGTCTCTGGGCCTCGAGAAGCCTACAACACTGGCTGTGGTGGATGGCAGCATCGGCAAGGTGCTGAC<br>CTACCGGAACATCAAACAGCTGCTGGGCGACAACTACCGGCTGCTGAACAGACAGCGGCAGCAGAAGCACACACT<br>GAGCCACCAGAGACAGGTGGCCCAGATTCTGGCTAGCCCTAATCAGCTGGGCGAGTCTGAGCTGGGCCAGTACGTT<br>GACAGACTGCTGGCTAAAGAAATCGTGGCCATCACACAGACCTACAAGGCCGGCTCTATCGTGCTGCCCAAGCTGG<br>GAGACATGAGAGAACAGGTGCAGTCCGAGATCCAGGCCAAGGCCGAGCAGAAGTCCGATCTGATTGAGGTTCAGC<br>AGAAGTACAGCAAGCAGTACCGGGTGTCCGTGCACCAGTGGTCTTACGGCAGACTGATCGCCAGCATCAGATCCAG<br>CGCCGCCAAAGTGGGCATCGTGATCGAGGAAAGCAAGCAGCCCATCCGGGGAAGCCCTCAAGAAAGGCCAGAGA<br>ACTGGCCATTGCCGCCTACAACTCCAGAAGGCGGACTTGA |
| | TracrRNA<br>(SEQ ID<br>NO: 1193) | TTGACAAAAAGCAGAACCTTGAAAATAGAATAGATATAACTAATAGCGCCGCAGTTCATGCTTTGTTCAAAGCCTCT<br>GTACTGTGTAAATGTGGGTTAGTTTGACTGTTGGAAAACAGTCTTGCTTTCTGACCCTGGTAGCTGCCCACCTTGATG<br>CTGCTGTCCCTTGAGGACAGGAATAAGGTGCGCCCCAGTAATAGAGGTGCGGGTTTACCGCAGTGGTGGCTACCG<br>AATCACCTCCGATCAAGGAGGAACCCACCTTAATTATTTATTTTGGCAAACCACAAGCGAGGTCAATTTTCCAGGG<br>AGGTTTGCCAAAAGTCCAAATCCCTTGTCTAGTCTGCGTTTTATTTATTGGTATGTTTCGATGATTCGCCTTGAAGGG<br>TGAAGTCGAGAGCAGATTTAGACACCTTTGCCAAAATCACTTTTGGAAGTGTCTCTAGATAAGGGTTTGGTCGGGCG<br>GAGTTTCAACACCCCTC |
| | DR<br>(SEQ ID<br>NO: 1194) | GTTTCAACACCCCTCCCGAAGTGGGGCGGGTTGAAAG |
| | sgRNA<br>(SEQ ID<br>NO: 1195) | TTGACAAAAAGCAGAACCTTGAAAATAGAATAGATATAACTAATAGCGCCGCAGTTCATGCTTTGTTCAAAGCCTCT<br>GTACTGTGTAAATGTGGGTTAGTTTGACTGTTGGAAAACAGTCTTGCTTTCTGACCCTGGTAGCTGCCCACCTTGATG<br>CTGCTGTCCCTTGAGGACAGGAATAAGGTGCGCCCCAGTAATAGAGGTGCGGGTTTACCGCAGTGGTGGCTACCG<br>AATCACCTCCGATCAAGGAGGAACCCACCTTAATTATTTATTTTGGCAAACCACAAGCGAGGTCAATTTTCCAGGG<br>AGGTTTGCCAAAAGTCCAAATCCCTTGTCTAGTCTGCGTTTTATTTATTGGTATGTTTCGATGATTCGCCTTGAAGGG<br>TGAAGTCGAGAGCAGATTTAGACACCTTTGCCAAAATCACTTTTGGAAGTGTCTCTAGATAAGGGTTTGGTCGGGCG<br>GAGTTTCAACACCCCTCGAAATCCCGAAGTGGGGCGGGTTGAAAGNNNNNNNNNNNNNNNNNNNNNNN |
| | LE<br>(SEQ ID<br>NO: 1196) | TATGGTAATAGTGCAAATGAAGATAGGAAGCACCTCGCCAACTTAGATCCGGAAAACGGGGTGAAGCGATCGCCTG<br>TTGGTTGACAACTGCACTTGTAGAGCGACAAATAATTTGTCGTTCTACAATTGTCGATTGCCAAATTATATGACCAC<br>TTGACAAGTTGATTCATTCAAAATTATCCTCAAAACCCTTGCCAAGCAAGGGTTTTGTTATTTTAGGCTCAAAAT<br>ACCCAGAAACTTATTGCCAAAATAGCTGTCCTCTTTTGAAAAGTTGACGAAATATCTGTCCTTGCTTGAAAAGGGAC<br>TTGAGGGAAGATTTTTACAGAAATTGACAAAATAAATGTCCTCCAAGTAGTACAATACAACTACGTTTTATTGAAC<br>ATTTATGTAAATATGCTGGATGATCCTGATAAGGGCAATCAAGAGCCAGAAACGCATGAGATAGTGACTGAGCTAT<br>CACTAGATGAGCAGCATTTGCTGGAAATGATTCAGAAAC |
| | RE<br>(SEQ ID<br>NO: 1197) | CCGAAGTGGGGCGGGTTGAAAGACCTTCATGCAAGGATATAAAAAATTTTAGGTGGGTTGAAAGGCGCACTTCGTT<br>CGGGATTTTCCCTGACCGAAACAGTACCAATAAATCAAAGCTATTATAATAACAGCTTCTAATGCCAATACACCTTG<br>ATGACTAAGTAATTTGGCAACGCGGACAACAACTTGGCAATACGGACAACAATTTGTCAACGCAGACAAAGAATTT<br>GGCAATCGACAACAATAATCGGGATGACTGGATTCGAACCAGCGGCCCCTTCGTCCCGAACGAAGTGCGCTACCAA<br>GCTGCGCTACATCCCGTTAAAAAATTTATACGCCTTTTTAGCATAACATAAATAATAGTCAATACAGAAAAGACAT<br>CTACATCTATATATATAGATGAATCGGAACGGGATTTGCTTGCTAGGATTAGATTTGTATAACATTCAGTGGTAAAA<br>GCGGATTGTGACTGTAAAACCAGACTGGTTGCGGGTAAAAG |
| CP003548/<br>Nostoc sp.<br>PCC 7107/<br>T59 | TnsB<br>(SEQ ID<br>NO: 1198) | ATGGACGAGATGCCCATCGTGAAGCAGGACGACGAGAGCCTGCCTGTGGAAAACAACGACGATGTGGATGAGATC<br>CAGGACGATGAGCTGGAAGAGACAAACGTGATCTTCACCGAGCTGAGCGCCGAGGCCAAGCTGAAGATGGATGTG<br>ATTCAGGGCCTGCTGGAACCCTGCGACAGAAAGACATACGGCGAGAAGCTGAGAGTGGCCGCCGAGAACTGGGA<br>AGACAGTGCGGACAGTGCAGCGGCTGGTCAAGAAGTATCAGCAGGACGGCCTGAGCGCCATCGTGGAAACCCAG<br>AGAAACAGAAGGAGCAGCTACCCGGATCAGACCCAGGTGGCAGAAATTCATCGTGAACACCTTCAAAGAGGGCAC<br>AAAGGGCTCCAAGAAGATGACCCCTGCTCAGGTGGCCATGAGAGTGCAAGTTCGGGCTGAACAGCTGGGCCTGAGA<br>AATTTCCCAGCCACATGACCGTGTACCGGGTGCTGAACCCCATCATCGAGCCGCAAGAGCGGAAGCAGAAGCGAGAG<br>AAACATCGGCTGGCGGGGCAGCAGAGTGTCCCACAAGACAAGAGATGGCCAGACACTGGACGTGCGGTACAGCAA<br>TCACGTGTGGCAGTGCGACCACACCAAGCTGGATGTCATGCTGGTGGACCAGTACGGCGAGCCTCTTGCCAGACCA<br>TGGTTCACCAAGATCACCGACAGCTACAGCCGGTGCATCATGGGCATCCACGTGGGCTTTGATGCCCCTAGCTCTCA |

TABLE 27-continued

| Name/Organism/System ID (T) | Sequences |
|---|---|
| | GGTTGTGGCCCTGGCCTCTAGACACGCCATTCTGCCTAAGCAGTACAGCGCCGAGTACAAACTGATCAGCGACTGG<br>GGCACCTACGGCGTGCCCGAGAATCTGTTTACAGACGGCGGCAGAGACTTCAGAAGCGAGCACCTGAAGCAGATCG<br>GCTTCCAGCTGGGCTTCACCTGAGTGTCACCTGAGAGACAGACCTAGCGAAGGCGGCATCGAGGGAAAGAAGCTTCGGAAC<br>AATCAATACCGAGTTCCTGAGCGGCTTCTACGGCTACCTGGGCAGCAACATCCAAGAGGAAGCAAGACCGCCGAG<br>GAAGAGGCCTGTCTGACACTGAGAGAGCTGCATCTGCTGCTCGTGCGCTACATCGTGGACAACTACAACCAGAGGC<br>TGGACGCCCGGACCAAGGACCAGACCAGATTTCAGAGATGGGAGGCCGGACTGCCTGCTCTGCCCAAGATGGTCAA<br>AGAGCGCGAGCTGGACATCTGCCTGATGAAGAAAACCCGGCGGAGCATCTACAAAGGCGGCTATCTGAGCTTCGAG<br>AACATCATGTACCGGGGCGATTACCTGGCCGCCTATGCCGGCGAGAATATCGTGCTGAGATACGACCCCAGAGACA<br>TCACCACCGTGTGGGTGTACAGAATCGATAAGGGCAAAGAGGTGTTCCTGTCCGCCGCTCATGCCCTGGATTGGGA<br>GACAGAACAGCTGTCCCTGGAAGAAGCCAAGGCCGCCTCTAGAAAAGTGCGGAGCGTGGGCAAGACCCTGAGCAA<br>CAAGTCTATCCTGGCCGAGATCCACGACCGGGACACCTTTATCAAGCAGAAGAAGAAGTCCCAGAAAGAGCGCAA<br>GAAAGAGGAACAGGCCCAGGTCCACGCCGTGTACGAGCCTATCAATCTGAGCGAGACAGAGCCCCTGGAAAAACCT<br>GCAAGAGACACCCAAGCCTGTGACCAGAAAGCCCCGGATCTTCAACTACGAGCAGCTGCGCGCAGGACTACGACGA<br>GTAA |
| TnsC<br>(SEQ ID<br>NO: 1199) | ATGAAGGACGACTACTGGCAGAGATGGGTGCAGAACCTGTGGGGCGACGAGCCCATTCCTGAAGAACTGCAGCCC<br>GAGATCGAGAGACTGCTGAGCCCTTCTGTGGTGGAACATCCAGAAGATCCACGACTGGCTGGACGGCC<br>TGAGACTGTCTAAGCAGTGCGGCAGAATTGTGGCCCCTCCTAGAGCCGGCAAGAGCGTGACATGTGACGTGTACCG<br>GCTGCTGAACAAGCCCCAGAAGAGAGGCGGCAAGCGGGATATTGTGCCCGTGCTGTATATGCAGGTCCCCGGCGAT<br>TGCTCTAGCGGAGAACTGCTGGTGCTGATCCTGGAAAGCCTGAAGTACGATGCCACCAGCGGCAAGCTGACCGACC<br>TGAGAAGAAGAGTGCAGCGCCTGCTGAAAGAAAAGCAAGGTGGAAATGCTGATTATCGACGAGGCCAACTTCCTCA<br>AGCTGAACACCTTCAGCGAGATCGCCCGGATCTACGACCTGCTGAGAATCAGCATCGTGCTCGTGGGCACCGACGG<br>CCTGGACAACCTGATTAAGAGAGAGCCCTACATCCACGACCGGTTCATCGAGTGCTACAAGCTGCCCCTGGTGGAA<br>AGCGAGAAGAAATTCACCGAGCTGGTCAAGATCTGGGAAGAAGAGGTGCTCTGCCTGCCTCTGCCTAGCAACCTGA<br>CCAGAAGCGAGACACTGGAACCCCTGCGGAGAAAGACCGGCGGAAAGATCGGACTGGTGGACAGAGTGCTGCGGA<br>GAGCCCTCTATTCTGGCCCTGAGAAAGGGCCTGAAGAATATCGACAAAGAAACCCTGACCGAGGTGCTGGATTGGTT<br>CGAGTGA |
| TniQ<br>(SEQ ID<br>NO: 1200) | ATGGAAATCGGAGCCGAGGAACCCCACATCTTCGAGGTGGAACCTCTGGAAGGCGAGAGCCTGTCTCACTTCCTGG<br>GCAGATTCAGAAGAGAGAACTACCTGACCAGCAGCAGCCAGCTGGGCAAGCTGACAGGACTGGGAGCTGTGGTGTCCC<br>GGTGAAGAAGCTGTACTTCAACCCATTTCCAACGCGGCAAGAGCTGGAAGCCCTGACCTCTGTCGTCAGAGTGAA<br>CGCCGATAGACTGGCCGAGATGCTGCCTCCTAAGGGCGTGACCATGAAGCCCAGACCTATCAGACTGTGCGCCGCC<br>TGTTATGCCGAGGTGCCCTGTCACAGAATCGAGTGGCAGTTCAAGGACGTGATGAAGTGCGACCGGCACAACCTGA<br>GACTGCTGACCAAGTGCACCAACTGCGAGACAAGCTTCCCCATTCCTGCCGAATGGGTGCAGGGCGAGTGCCCCTCA<br>CTGCTTTCTGCCTTTTGCCACCATGGCCAAGCGGCAGAAACACGGCTAA |
| Cas12k<br>(SEQ ID<br>NO: 1201) | ATGAGCGTGATCACCATCCAGTGCAGACTGGTGGCCGAAGAGGACATCCTGAGACAGCTGTGGGAGCTGATGGCCG<br>ACAAGAACACCCCTCTGATCAACGAGCTGCTGGCCCAAGTGGGAAAGCACCCCGAGTTTGAGACATGGCTGGACAA<br>GGGCAGAATCCCCACCAAGCTGCTGAAAACCCTGGTCAACAGCTTCAAGACCCAAGAGAGATTCGCCGACCAGCCT<br>GGCAGATTCTACACCTCTGCCATTGCTCATGGACTACGTGTACAAGAGTTGGTTCGCCCTGCAGAAGGCGGCGGAA<br>GAGACAGATCGAGGGCAAAGAGAGATGGCTGACCATCCTGAAGTCCGACCTGCAGCTGGAACAAGAGTCCCAGTG<br>TAGCCTGAGCGCCATCAGGACCAAGGCCAACGAGATCCTGACACAGTTCACCCCTCAGAGCGAGCAGAACAAGAA<br>CCAGCGGAAGGGCAAAAAGACCAAGAAGTCCACCAAGTCCGAGAAGTCCAGCCTGTTCCAGATCCTGCTGAACACC<br>TACGAGCACCAGATCCTCTGACCAGATGCCCATTGCCTACCTGCTGAAGAACAACTGCCAGATCAGCGAGC<br>TGGACGAGGACAGCGAGGAATTCACCAAGAACCGCCGGAAGAAAGAGATTGAGATCGAGCGCCTGAAGAATCAGC<br>TGCAGAGCAGGATCCCTAAGGGCAGAGATCTGACCGGCGAGGAATGGCTCAAGACCCTGGAAATCAGCACCGCCA<br>ACGTGCCCCAGAACGAGAATGAAGCCAAGGCCTGGCAAGCCGCTCTGCTGAGAAAAAGCGCCGACGTGCCATTTCC<br>TGTGGCCTACGAGGACAACGAGGACATGACCTGGCTGCAGAACATCACAGAGAGACAGAGCTGTTCGTGCGGTTCAACGGC<br>CTGGGCAAGCTGACCTTCGAGATCTACTGCGACAAGCGGCATCGCACTACTTCAAGCGGTTTCTCGAGGACCAAG<br>AGCTGAAGCGGAACCACAAGAATCAGTACAGCAGCTCCCTGTTCACCCTGCGGAGTGGTAGACTTGCTTGGAGCCC<br>TGGCGAGGAAAAAGGCGAGCCCTGGAAAGTGAACCAGCTGCACCTGTACTGCACCCTGGACACCAGAATGTGGAC<br>CATCGAGGGAACCCAGCAGGTCGTGGACGAGAAAGCACCAAGATCAACGAAACCCTGACAAAGGCCAAGCAGAA<br>GGACGACCTGAACGACCAGCAGCAGGCCTTCATCACCAGACAGCAGAGCACACTGGACCGGATCAACAATCTGTTC<br>CCCAGACCTAGCAAGAGCAGATACCAGGGCCAGCCTTCTATCCTCGTGGGCGTGTCCTTCGGCCTGAAAAAGCCTGT<br>GACAGTGGCCGTGGTGGACGTGGTCAAGAATGAGGTGCTGGCCTACAGAAGCGTGAAACAGCTGCTGGGCGAGAA<br>CTACAATCTGCTGAACCGGCAGCGACAGCAGCAGCAGCAGCAGTGCTCACAGAGGACACAAGGCCCAGAGCAGAA<br>CGCCCCTAACAGCTTTGGCGAGTCTGAGCTGGGCCAGTACATCGACGACTGCTGGCTGACGCCATCATTGCCATTG<br>CCAAGACATACCAGGCCGGCTCCATCGTGCTGCCCAAGCTGAGAGATATGAGAGAGCAGATCAGCAGCGAGATCCA<br>GAGCAGAGCCGAGAAGAAGTGCCCCGGCTACAAAGAGGTGCAGCAGAAGTACGCCAAAGAATACCGGATGAGCGT<br>GCACCGGTGGTCCTACGGCAGACTGATCGAGTGCATCAAGAGCCAGGCCGCCAAGGCCGGAATCTCTACAGAGATC<br>GGCACCCAGCCTATCCGGGGGCTCTCCTCAAGAGAAGGCCAGAGATGTGGCCGTGTTCGCCTACCAAGAAAGACAGG<br>CCGCTCTGATCTGA |
| TracrRNA<br>(SEQ ID<br>NO: 1202) | TTCACTAATCCGAACCTTGAAAATATAATATTTTTATAACAGCGCCGCAGTTCATGCTTTTTTAAGCCAATGTACTGT<br>GAAAAATCTGGGTTAGTTTGGCGGTTGGAAGGCCGTCATGCTTTCTGACCCTTGTAGCTGCCCGCTTCTGATGCTGC<br>CATCTTTAGAATTCTATAGGTGGGATAGGTGCGCTCCCAGCAATAAGGAGTAAGGCTTTTAGCTATAGCCGTTATTC<br>ATAACGGTGCGGATTACCACAGTGGTGGCTACTGAATCACCCCCTTCGTCGGGGGAACCCTCCCAAATATTTTTTG<br>GCGTGTCAAAGTGGGGGCAAAATCCCCGGAGTCCCGCCAAAACTTTAAAACCCTTATCCAGTCTTGAATTAAGAAA<br>CTAGTATGTAAATCAATTTAGTATTTTAATTTTCAGATCGAGACTATTTTAAGCTGACCTGCCAAAGTATGTGTATGG<br>AAAGCTTTGATAGCAAGGGTTCTAGACGGGTCG |
| DR<br>(SEQ ID<br>NO: 1203) | GTTTCAACAACCATCCCGGCTAGAGGTGGGTTGAAAG |
| sgRNA<br>(SEQ ID<br>NO: 1204) | TTCACTAATCCGAACCTTGAAAATATAATATTTTTATAACAGCGCCGCAGTTCATGCTTTTTTAAGCCAATGTACTGT<br>GAAAAATCTGGGTTAGTTTGGCGGTTGGAAGGCCGTCATGCTTTCTGACCCTTGTAGCTGCCCGCTTCTGATGCTGC<br>CATCTTTAGAATTCTATAGGTGGGATAGGTGCGCTCCCAGCAATAAGGAGTAAGGCTTTTAGCTATAGCCGTTATTC<br>ATAACGGTGCGGATTACCACAGTGGTGGCTACTGAATCACCCCCTTCGTCGGGGGAACCCTCCCAAATATTTTTTG<br>GCGTGTCAAAGTGGGGGCAAAATCCCCGGAGTCCCGCCAAAACTTTAAAACCCTTATCCAGTCTTGAATTAAGAAA |

TABLE 27-continued

| Name/<br>Organism/<br>System<br>ID (T) | | Sequences |
|---|---|---|
| | | CTAGTATGTAAATCAATTTAGTATTTTAATTTTCAGATCGAGACTATTTTAAGCTGACCTGCCAAAGTATGTGTATGG<br>AAAGCTTTGATAGCAAGGGTTCTAGACGGGTCGGAAATCCCGGCTAGAGGTGGGTTGAAAGNNNNNNNNNNNNNNN<br>NNNNNNNNNNN |
| | LE<br>(SEQ ID<br>NO: 1205) | AGCAAATATTGCTATCATATTTTTTAGTTTAGTTATACTTCCATGAGATATTCAACAAGTATCAACCTCAATTAAAT<br>GCAGATAAATTTAAGTTGTTGAATAACTAATTATTTGTCGTCTTAACAAAATAATGTCGTCAAATATAAAACTATCA<br>AAAATGTTGCTACATGAGTGTTTACAACGTTTTTTATTATGTAATGGGTTAGTAGTTTATTTAACACTTTACTTGTCG<br>TTGATTTAAATAATAACAAAATAAACGTCGTCTTTTAAAATTTTACGTTTTCTAAAATTTTCTAGTTTCATAACAAAT<br>TAGCTGTCGCTTTTTAGCTTGAATAGTGGTATTATAATTTTATTTAGTACATTTGCACTAAATAATACATCCTTATAC<br>CGAAAAGTTGCCGCGTCCATTGAGGGGTCAACTGCTTTAGGAAGTTTGGATGTTCTCGCACAATAGCGAGATTGTGA<br>TTACTGTTTTGAGTATGAATCAAGTTTTCCTATG |
| | RE<br>(SEQ ID<br>NO: 1206) | AGTTTCAACAACTATCCCAGCTAGGGATGAGTTGAAAGAGCGTCAGAAAATATTTAACAGAGGGTTGAAAGGTGCA<br>TCCGACTTGTAAGCATATTTATGAATATTATCAGGGAAGTCATCAAATAAAGATTTAGCTATATTTCCTGTACAATA<br>GATGTCTGCAAACACTTTATCAAATTGGTTAGACGACATTAATTTGTTAACGTTTCGCAATTAGCATTATACGACACT<br>AATTTGTTAACAGTGACATTAATTTGTTAATAGCGACAGCAATCGTTAACAACGACAAATAATTAGTTATTCGACA<br>TAAGTTAAAGCCAGCAGCTGGATTTGAACCTGCGACCTTCCGATTACAAGTCGGATGCACTACCACTGTGCTATGCT<br>GGCATTATTAAGCTCACCGATTTATGATTATAACATAAGCAAAATATTTGTCTAGAGGAAGCTGCGAAAAAAATTTG<br>CTTGGATGTTCGAGACTGGAAGGTTAGTACTTCAACCT |
| PVWN01000012.1/<br>Chlorogloea<br>sp.<br>CCALA 695/<br>T60 | TnsB<br>(SEQ ID<br>NO: 1207) | ATGCAGGACGACAGATCCCTGGAAGTGCCCATTCCTGCCGAAGTGAACGAGATCGTGACCGACTTCAGCGACGACG<br>CCAAGCTGATGCAGAAAGTGATCCAGAGCCTGCTGGAACCCTGCGACAGAATCACCTACGGCCAGAGACAGAGAG<br>AGGCCGCTGCCAAGCTGGGAAAGTCTGTCGCGGACCATCAGACGGCTGGTCAAGAAGTGGGAAGCCGAGGGACTGA<br>ATGCCCTGCAGGCCACACAGAGAACCGACAAGGGCAAGCACCGGATCGACCAGAAGTGGCAAGAGTTCATCATCA<br>AGACCTACAAAGAGGGCAACAAGGGCAGCAAGCGGATCACCCCTCAGCAGGTTGCAGTTAGAGTGGCCGCCAAAG<br>CCGGCGAGCTGGGCCAAGAGAAGTACCCCAGCTACCGGCCTGTACAGAGTGCTGCAGCCCATCATCGAGAAGCA<br>GGACAAGCACAGAGCGTGCGGAGCAGAGGCTGGCGAGGATCTAGACTGAGCGTGAAAACCAGAGATGGCCAGGA<br>CCTGAGCGTGGAATACTCCAACCACGTGTGGCAGTGCGACCACACCGAGCTGATGTGCTGCTGGTGACAGAGAT<br>GGACAGCTGCTTGGCAGACCTTGGCTGACCACCGTGATCGACACCTACAGCAGATGCATCATCGGCATCAACCTGG<br>GCTACGACGCCCCTAGTTCTCAGGTTGTGGCTCTGGCCCTGAGACACGCCATTCTGCCTAAGCAGTACAGCAGCGAG<br>TACAAGCTGCACTGCGAGTGGGGCACATACGGCAAGCCTGAGCACTTCTACACCGACGGCGGCAAGGACTTCAGAA<br>GCAACCATCTGCAGCAGATCGGCGTGCAGCTGGGCTTCGTGTGTCACCTGAGAGACAGACCTAGCGAAGGCGGCAT<br>CGTGGAAAGACCCTTCGGCACCTTCAACACCAACCTGTTCAGCACCCTGCCTGGCTACACCGGCAGCAATGTGCAA<br>GAGAGGCCTGAAGAGGCCGAGAAAGAGGCCAGCCTGACACTGAGAGAGCTGGAACAACTGCTCGTCGGTACATC<br>GTGGACAAGTACAACCAGAGCATCAGCCCGGATGGGCACTAGACCAGATTTCAGAGATGGGAGGCCGGACTG<br>ATCGCCGTGCCTTCTCCAATCAGCGAGAGAGATCTGGACATCTGCCTGATGAAGCAGACCAGAGGACCATCTACA<br>GAGGCGGCTACCTGCAGTTCGAGAACCTGACCTACAGGGGCGACAGATGGAAGTGTATGCCGGCGAGTCTGTGGT<br>GCTGAGATACGAGGAAAAGGACATCACCACCATCCTGGTGTACCGGAAAGAAGGCGGGAAAGAAGTCTTTCTGGC<br>CCACGCCTACGCACAGGATCTGCAGACAGAGCAGCTGAGCTTTGACGAGGCCAAGGCCAGCAGCCGGAAGCTTAG<br>AGATGCCGGAAAGGCCGTGTCCAACAGATCCATCCTGGCTGAAGTGCGGTACTCCGCTTCTGCTCTGGCTGAGCTGA<br>GAGAGACATTCCTGGCTCAGAAGAAGTCCAAGAAAGAGCGGCAGAAAAGCGAACAGGTGCAGATCCACCGGAAGA<br>AAGAACTGTTCCCCATCGAGGCCGAAGCCACCGAGTTTGAGTCTCTGGTGGATGAGCTGGAAACCGAGACAATCGA<br>GGTGTTCGACTACGACGATGAGGGAAGATTACGGCCTGTGA |
| | TnsC<br>(SEQ ID<br>NO: 1208) | ATGAATCAAGAGAAAGAGGCCAAGGCTATCGCCCAGCAGCTGGGAAACATCCCTCTGAACGACGAGAAGATCCAG<br>GTGGAAATCCAGCGGCTGAACCGGAAGAACTTCGTGCCCCTGGAACAAGTGAAGGCCCTGCACGATTGGCTGGAAA<br>GCAAGAGACAGGCCCGGCAGTGCTGTAGAGTGATCGGCGAAAGCAGAACCGGCAAGACCATGGCCTGCAACGCCT<br>ACAGACTGCGGCACAAGCCTATCCAGCAACTGGGCCAGCCTCCTATCGTGCCCGTGGTTGTACATCCAGATTCCTCAA<br>GAGTGCAGCCCCAAAGAACTGTTCAGCGTGGTCATCGAGCACCTGAAGTACCAAGTGACCAAGGGCACCACCGCCG<br>AGATCAGAAACAGAACCCTGCGGGTGCTGAAAGGCTGCGGCGTGGAAATGCTGATCATCGACGAGGCCGACCGGC<br>TGAAGCCTAAGACCTTTGCTGACGTGCGGGACATCTTCGACAACCTGGAAATCTCCGTGGTGCTCGTGGGCACCGAC<br>AGACTGGACAAGTGATGATCAACAACGACGAGCAAGTGCTGAAGCTGTGCAACAGATTCAGCGCCGACTACAGATA<br>CCAGATACGGCAAGATCAGCGGCGAGGAATTCAAGCGGACCGTGAACATCTGGGAGAACCAGGTGCTGAAGCTGCCCGTGCTGAGCAATCTGA<br>CCCAGCCTAAGATGCTGAAATCCTGAGAAACAAGACCCAGGGCTACATCGGCCTGATGGACATGATCCTGAGGGA<br>CGCCGCTATCAGAGCCCTGAAGAAAGGCATGCCCAAGATCGACCTGGACACCCTGAAAGAAGTGACGAACGAGTA<br>CACAGCCCCTCCAAAGACACAGAAGTGA |
| | TniQ<br>(SEQ ID<br>NO: 1209) | ATGAAGACCAGCGACTTCCAGCCTTGGCTGTTCTGCGTGAACCTTTCGAGGGCGAGAGCATCAGCCACTTTCTGGG<br>CAGATTCAGACGGGCCAACGAGATGACCCCTAACGGACTGGCTAAAGCCGCTGGACTGGAAGGCGCCATTGCCAGA<br>TGGGAGAAGTTCCGGTTCAACCCTCCACCTAGCCGGCAGCAACTGGAAGCTCTGGCTGTGCTTGTTGGCCTGGAAGC<br>CGATAGACTGGTGCAGATGCTGCCTCCTGTTGGCGTGGGCATGAAGATGGAACCCATCAGACTGTGCGGCGCCTGC<br>TATGCCCAGTCTCCTTGTCACAAGATCGAGTGGCAGTTCAAGAGCACCCAGGGCTGTGGGCGATAGCCACAGAC<br>ACAAGCTGAGCCTGCTGAGCGAGTGCCCTAATTGCGGCGCCAGATTCAAGATCCCCGCTCTGTGGGTTGACGGCTG<br>GTGCCACAGATGCTTTCTGCCCTTCGAGGAAATGACCAAGCACCAGAAACTGATCCAGGTGTAG |
| | Cas12k<br>(SEQ ID<br>NO: 1210) | ATGAGCCAGATCACCATCCAGTGCCGGCTGATCACCAGCGAGAGCACAAGACACCACCTGTGGAAGCTGATGGCCG<br>ACCTGAACACCCCTGATCAACAGCTGCTGACCGACATCGCTGAGTTTGAGACATGCGGAAGAA<br>GGGCAAGCTGCCTGGCGGCACAGTGAACAGCTGTGCCAGCCTCTGAAAACCGACAGCCGGTTCAACAACCAGCCT<br>GGCCGGTTTTACAAGAGCGCCATCACCGTGGTCGAGTACATCTACAAGTCCTGGTTCAAGATCCAGCAGCGGCTGG<br>AACAGAAGCTGAAGGGCCAGACCAGATGGCTGGAAATGCTGAAGTCCGACGAGGAACTGACCACCGAGTCTAACG<br>CCAGCCTGGAAACCATCTGCACCAACGCTGCTCAGCTGCTGTCTGCTCGTGTCCTGAGGAAGGCAGCATCAGCAAG<br>AGACTGTGACAGGCCTACAACGACACCGACGACTGCTGACAAGATGCGTGATCTGCTACCTGCTGAAGAACGGCA<br>GCAAGATCCCCAAGAAGCTGGAAGAGAACCTGGAAAAGTTCGGCCTGCACAGACGGCAGGCCGAGATCAAGATCG<br>AGCGGATCAAAGAGCAGCTGGAAAGCAGAATCCCCAACGGCAGGGACCTGACCAGAAAGAACTGGCTGGACACCC<br>TGGAACTGGCCAGCACAACAGCCCCTGAGAAAGCCCAAGTCTTGGAAGGACGCCCTGAGCACAGAGA<br>GCAAGCTGCTGCCTTTTCCAGTGGCCTACGAGACAAACGAGGACCTGACATGTCCAAGACGAGAAGGACCGGCT<br>GTGCGTGCAGTTCAACGCCTGAGCAAGACACATCTTCCAGATCTACTGCGACCAGCGCCAGCTGGAATGGTTCAAG<br>CGGTTCTACGAGGACCAAGAGATTAAGAAGGCCTCTAAGAACGAGTACAGCTCCGCCTGTTCACCCTGAGATCTG<br>GCAGAATCGCTGGCAAGAGGGCACAGAGAAAGGCGAGTGTGGAACATCCACCACCTGATCCTGTACTGCGCCGT<br>GGACACCAGACTGTGGACAGCCGAGGGAACAGAGCAAGTGCGGCAAGAGAAGGCCGAGGATATCGCCAAGACACT |

TABLE 27-continued

| Name/<br>Organism/<br>System<br>ID (T) | | Sequences |
|---|---|---|
| | | GACCAACATGAACAAGAAGGGCGACATCAACGACAAGCAGCAGGCCTTCATCCGGCGGAAGCAGTCTACACTGGC<br>CAGACTGGACAACCCATTTCCTCGGCCAAGCAAGCCCTTCTACCAGGGCCAGCCTCACATCCTTGTGGGAGTTGCCC<br>TGGGCCTTGATAAGCCTGCTACAGTGGCCGTGGTTGATGGCCTGGCCTCCAAAGAGATCACCTACCGCTCTGTGAAA<br>CAGCTGCTGGGCGACAACTACGAACTGCTGAACAAGCAGCGGCAGCTGAAGCAGAGACAGTCCTCCACCAGAGACAC<br>AAAGCCCAGAGCGGCGGCAGATTCAACCAGTTCAGAGATAGCCAGCTGGGCGAGTACGTGGACAGACTGCTGGCC<br>AAGGCCATTATCGCCTTCGCTCAGACATACCACGCCGGCTCTATCGTGCTGCCCAAGCTGGGAGACATGAGAGAAC<br>TGGTGCAGAGCGAGGTGCAGGCCAGAGCCGAGCAGAAGATCCCTGGATATCTGGAAGGCCAGAAGAAGTACGCCA<br>AGCAGTACCGGGTGTCCATCCACCAGTGGTCTTACGGCAGACTGATCGACAACATCAAGGCACAGGCCGCCAAGCT<br>GAACCTGGTGGTGGAAGAGTGTCAGCAGAGCATCAGAGGCAGCCCTCAAGAGAAAGCCAAAGAAATGGCCATCTC<br>CGCCTACCGGGACCGCAGCATCTCTAAGACATGA |
| | TracrRNA<br>(SEQ ID<br>NO: 1211) | TCTTAATTCTGCACCTTGACAATAAAATAGAGTTATCAATCGCGCCGTAAGTCATGTTCATTTGAACCTCTGAATTGC<br>GAAAAATCTGGGTTAGTTTAACTGTCTGCCGACAGTTGTGCTTTCTGAAGAAAGGTAGCTGCTCACCCTGATGCTGC<br>TGTCTTCGGACAGGATAGGTGCGCTCCCAGCAATAAGCGGCATGGGTCTACTACTGTAGTGGCTACCGAATCACCTC<br>CGAGCAAGGAGGAACCCTCCTTAATTATTCATTTGAAGGACTAAAAATAAGGCAAAATTTCTAAGATATCCGCGCA<br>AGTCCTAAATTGCTTGCTCTGTCTAAATCTCATCATTTCTAACCCAGACATGATTTTGTGGTGATAGTTTGAAGGAT<br>GGGTTAATTCCAATCCCAT |
| | DR<br>(SEQ ID<br>NO: 1212) | GTGACAACAACCCTCCTATTACAGGGTGGGTTGAAAG |
| | sgRNA<br>(SEQ ID<br>NO: 1213) | TCTTAATTCTGCACCTTGACAATAAAATAGAGTTATCAATCGCGCCGTAAGTCATGTTCATTTGAACCTCTGAATTGC<br>GAAAAATCTGGGTTAGTTTAACTGTCTGCCGACAGTTGTGCTTTCTGAAGAAAGGTAGCTGCTCACCCTGATGCTGC<br>TGTCTTCGGACAGGATAGGTGCGCTCCCAGCAATAAGCGGCATGGGTCTACTACTGTAGTGGCTACCGAATCACCTC<br>CGAGCAAGGAGGAACCCTCCTTAATTATTCATTTGAAGGACTAAAAATAAGGCAAAATTTCTAAGATATCCGCGCA<br>AGTCCTAAATTGCTTGCTCTGTCTAAATCTCATCATTTCTAACCCAGACATGATTTTGTGGTGATAGTTTGAAGGAT<br>GGGTTAATTCCAATCCCATGAAATCCTATTACAGGGTGGGTTGAAAGNNNNNNNNNNNNNNNNNNNNNNNNN |
| | LE<br>(SEQ ID<br>NO: 1214) | TTGCCTCCAATCGTCAGCAACGCTCACATCCATAAAGTTGCTAATTTTCCATCAACTCAGCTTACGACACCGAGAAT<br>TTGCAGAGGTACTAATTTGTCGATTGCCACATTATTTGTCCACTTGCCAAATTATTGACCGCTAATTCTAATAGCTTG<br>CTAGCCTAATCTACACAAGGGTTACAGCTATTAAATCTCCTAAAAATATTGAATAAGCTTTTTGACAAATTAGTTGT<br>CCGGTTTATGAAACTTGACAAATTCTTTTGTCCTCTCTTGAAAGAGGCGAAAATCACAACTTTTGTAAAGAATTGACA<br>CAATCTTTGTCCTTAAAAGGATAATACAAACATGATTGTATAAAACAATTGTGTAAATATGCAGGATGATCGCTCCT<br>TGGAAGTACCAATACCTGCTGAAGTAAATGAAATCGTCACTGATTTCTCTGATGATGCAAAGCTGATGCAGGAAGT<br>GATCCAGAGTCTTTTGGAACCCTGTGATCGCATTACCT |
| | RE<br>(SEQ ID<br>NO: 1215) | GTGACAACAACCCTCCTATTACAGGGTGGGTTGGAAGTGATTACTGTCTCGATGTGCTGGGCGCGATCGCCCAATAG<br>TTTCAACACCCCTCCCAGCTAGAGGCGAGTTGAAAGTAGTCGTGGTACGAGAAGTGGAAGAAAAGGATCGGGCTGT<br>TTCAACTTTCCTTCCAGCTAGGGCGGGTTGAAAGTCAATCCCTATATTGTTGGCGGTTTAAGCGCGATCAGTGTTTCA<br>ACTCCACTCCTAACAGGAGGCAGGTTGAAAGATATGACAAAGTTTGCAAAAGCAAAAGCTTTTGAAGAAAAAGGTG<br>GGTTGAAAGGCGCACTTCGTTCGGGATTGTTCCGACTTAGTAATTACAAAGTTAATAGGGTGGAGTTATCATAGAAA<br>CTCACAGAAATTCTGCCCGGTTGATTAAAGGAAGAACCGACCTATCAAGCGGACACTAATTTGTCAAAGCGACATC<br>AATTTGACAACGACGACAAATAATTAGTCAATCGACAAATTTTGTACATTCGCACATTATATGTCGCAATTCTCAAG<br>CCAGGTCGTAACTGCTTTTAAAGCCTGAGAACTCAATCGTGTAACCATCGTAGTCTATTTACC |
| LUHJ01000061.1/<br>Anabaena<br>sp. 4-3/<br>T61 | TnsB<br>(SEQ ID<br>NO: 1216) | ATGAGCGGCTTTCACAGCATGGCCGACAGAGAGATCGAGTTCACCGAGGAAAGCACCCAGGACAGCGACGCCATC<br>CTGCTGGACAACAGCAACTTCGTGGTGGACCCCAGCCAGATCATCCTGGCCACAAGCGACAAGCACAAGCTGACCT<br>TCAACCTGATCCAGTGGCTGGCTCAGAGCCCCACCAGAACCGTGAAGTCCGAGAGAAAGCAGGCCATTGCCAACAC<br>ACTGAGCGTGTCCACCAGACAGGTGGAAGCGGCTGCTGAAGCAGTACAACAGGACAAGCTGAGAGACAGCGCGG<br>CACCGAGAGAGCCGATAAGGGCAAGCACAGAGTGTCCGAGTACTGGCAAGAGTTCATCAAGCACCTACGAGAA<br>GTCCCTGAAGGACAAGCACCCTATCAGCCCCGCCTCTATCGTGCGGGAAGTGAAGAGACACGCCATCGTGGACCTG<br>GGACTGAAGCCTGGCGATTATCCACACCAGGCCACCGTGTACCGGATCCTGGAACCTCTGATTGCCCAGCACAAGA<br>GAAAGACCAAGAGTGCGAATCCTGGCAGCGGCAGCTGGATGACAGTGGTCACAAGAGATGCCAGCTGCTGAGAG<br>CCGACTTCAGCAACCAGATCATTCAGTGCGACCACACCAAGCTGGACATCCGGATCGTGGACATCCACGGCGATCT<br>GCTGAGCGAAAGACCTTGGCTGACCACCGTGGTGGATACCTACAGCTCTTGCGTGCTGGGCTTCAGACTGTGGATCA<br>AGCAGCCTGGCAGCACCGAAGTTGCCCTGGCTCTGAGACATGCCATTCTGCCCAAGCAGTACCCCGACGACTACCA<br>GCTGAACAAGACTGGAACGTGTACGGCAACCCCTTCCAGTACTTCTTCACCGACGGCGCGCAAGGACTTCAGAAGC<br>AAGCACCTGAAGGCCATCGGCAAGAAACTGGGCTTCCAGTGCGAGCTGAGGGACAGACCTCCTGAAGGCGGCATC<br>GTGGAACGGATCTTCAAGACCATCAACACCCAGGTGCTGAAGGACCTGCCTGGCTACACAGGCGCCAATGTGCAAG<br>AGAGGCCTGAGAACGCCGAGAAAGAGGCCTGTCTGACCATCCAGGACCTGGACAAGATCCTGGCCTCCTTCTTCTG<br>CGACATCTACAACCACGACCGTATCCTAAAGAGCCCCGGGACACCAGATTCGAGCGGTGGTTTAAAGGCATGGGC<br>TGCCCGGACGGCTGGATGAGAGAGACTGGATATCTGCCTGATGAAAGAAACCCAGAGAGTGGTGCAG<br>GCCCACGGCAGCATCCAGTTCGAGAACCTGATCTACAGAGGCGAGTCTCTGAAGGCCCACAAGGGCGAGTACGTGA<br>CCCTGAGATACGACCCCGACCACATCCTGACACTGTTCGTGTACAGCTGCGAGACAGACGACAACCTGGAAGAGTT<br>CCTGGGCTATGCCCACGCCGTGAACATGGACACACACGACCTGAGCCTGGAAGAACTGAAAACCCTGAACAAAGA<br>GCGGAGCAAGGCCCGGAAAGAGCACTTCAATTACGACGCCCTGCTGGCCCTGGGCAAGAGACAAGGACTTCAGAAGC<br>CGAGCGGAAGGCCGACAAGAAAGAAGAGGCCAGCGAGCGAAGCGGCTGAGAAGCGCCAGCAAGAAGGACA<br>GCAACATCATCGAGCTGCGGAAGTCCCGGGTGTCCAAGAGCCTGAGAAAGCAAGAGACTCAAGAGATCCTGCCTGA<br>GAGAGTGTCCAGGGAAGAGATCAAGTTTGAGAAGATCGAACTCGAGCCCCAAGAAACCCTGAGCGCTAGCCCCAA<br>GCCTAATCCTCAAGAGGAACAGAGACACAAGCTGGTGCTGAGCAAGAGGCAGAAGAACCTGAAGAACATCTGGTG<br>A |
| | TnsC<br>(SEQ ID<br>NO: 1217) | ATGGCCAGATCTCAGCTGGCCAACCAGCCTATCGTGGAAGTGCTGGCTCCTCAGCTGGACCTGAATGCCCAGATCGC<br>CAAGGCCATCGACATCGAGGAAATCTTCCGGAACTGCTTCATCACCACCGACCGGGTGTCCGAGTGCTTCAGATGG<br>CTGGACGAGGCTGCGGATCCTGAAGCAGTGCGAGAATCATCGGCCCCAGAAACGTGGGCAAGGACAGCAGCGCC<br>CTGCACTACAGAGATGAGGACAAGAAACGGATCAGCTACGTGAAGGCTTGGAGCGCCAGCAGCAGCAAGAGAATC<br>TTCAGCCAGATTCTGAAGGACATCAACCACGCCGCTCCTACCGGCAAGAGACAGGATCTCAGACCTAGACTGGCCG<br>GCAGCCTGGAACTGTTCGGACTGGAACTGGTCATCATCGACAACGCCGACAACCTGCAGAAAGAGGCCCTGATCGA<br>CCTCAAGCAGCTGTTCGAGGAATGCCACGTGCCAATCGTGCTGATCGGCGGCAAAGAGCTGGACAACATTCTGCAG<br>GACTGCGACCTGCTGACCAACTTTCCCACACTGTACGAGTTCGAGCGGCTGGAATACGACGACTTCAGAAAGAGCCC

TABLE 27-continued

| Name/<br>Organism/<br>System<br>ID (T) | Sequences |
|---|---|
| | TGAGCACCATCGAGCTGGATATCCTGAGCCTGCCTGAGTCTAGCCATCTGGCCGAGGGCAACATCTTCGAGATCCTG<br>GCCGTGTCTACCAGCGGCAGGATGGGCATCCTGGTCAAGATCCTGACAAAGGCCGTGCTGCACAGCCTGAAGAACG<br>GCTTCGGAAGAGTGGACGAGAGCATCCTGGAAAAGATCGCCAGCAGATACGGCACCAAATACGTGCCCCTGGAAA<br>ACCGGAACCGGAACGAGTAA |
| TniQ<br>(SEQ ID<br>NO: 1218) | ATGGTGCAGAATATGTTCCTGAGCAAGACCGAGACAGGCATGAACGAGGACGACGAGATCAGACCCAAGCTGGGC<br>TACGTGGAACCTTACGAGGGCGAGAGCATCAGCCACTACCTGGGCAGACTGCGGAGATTCAAGGCCAACAGCCTGC<br>CTAGCGGCTACAGCCTGGGAAAGATTGCTGGACTGGGCGCCGTGACCACCAGATGGGAGGAAGCTGTACTTCAACCC<br>ATTTCCTAACCGGCAAGAGCTGGAAGCCCTGGCCTCTGTTGTGGGAGTGTCTGCCGAGCGGTTCATCGAGATGCTGC<br>CTCCAAAGGGCGTGACCATGAAGCCCAGACCTATCGAGACTGTGCGCCGCCTGTTATGCCGAGGTGCCCTGTCACAG<br>AATCGACTGGCAGTTCAAGGACAAGATGAAGTGCGACCGGCACAACCTGCGGCTGCTGACCAAGTGCACCAACTGC<br>GAGACACCCTTTCCTATACCTGCCGATTGGGCCCAGGGCGAGTGTCCTCACTGTAGCCTGAGCTTCGCCAAGATGGT<br>CAAGCGGCAGAAACTGCGGGTGA |
| Cas12k<br>(SEQ ID<br>NO: 1219) | ATGAGCGTGATCACCATCCAGTGCAGACTGGTGGCCGAAGAGGACACCCTGAGAACACTGTGGGAGCTGATGGCCG<br>ACAAGAACACCCCTCTGATCAACGAGATTCTGGCCCAAGTGGGCAAGCACCCCGAGTTCGAAACCTGGCTGGAAAA<br>GGGCAAGATCCCCACCGAGCTGCTGAAAACCCTGGTCAACAGCCTGAAAACGCAAGAGAGATTCGCCAGCCAGCCT<br>GGCAGATTCTACACCCTCTGCCATTGCTCTGGTGGACTACGTGTACAAGAGTTGGTTCGCCCTGCAGAAGCGGCAGA<br>GAGACAGATCGAGGGCAAAGAGAGATGGCTGACCATCCTGAAGTCCGACCTGGAACTGGAACAAGAGTCCCAGTG<br>CAGCCTGAACATCATCCGGACCAAGGCCACCGAGATCATCACCGAGTTTACCCCTCAGAGCGACCAGAACAACAGC<br>CAGAAGAAGCGGAAGAAAACCACCAAGAGCACCAAGCCTAGCCTGTTCCAGATCCTGCTGAACAACTACGAGGAA<br>ACCCAGGACATCCTGACCAGATGCGCCCTGGCCTACCTGCTGAAGACAATTGCCAGATCAGCGAGCGGGACGAGA<br>ACCCCGAGGAATTCACCAGAAACCGCCGGAAGAAAGAGATTGAGATCGAGCGGCTGAAGGACCAGCTGCAGAGCA<br>GAATCCCCAAGGGCAGAGATCTGACCGGCGAGGAATGGCTCAAGACCCTGGAAGTTGTGCGGGCCAACGTGACCC<br>AGAACGAGAATGAAGCCAAGGCCTGGCAGGCCGCCATCCTGAGAAAATCTGCCGACGTGCCATTTCCTGTGGCCTA<br>CGAGAGCAACGAGGACATGACCTGGCTGCAGAACGATAAGGGCAGACTGTTCGTGCGGTTCAACGGCCTGGGCAA<br>GCTGACCTTCGAGATCTACTGCGACAAGCGGCATCTGCACTACTTCAAGCGCTTTCTCGAGGACCAAGAGCTGAAGC<br>GGAACAGCAAGAACCAGTACAGCAGCAGCCTGTTTACCCTGCGGAGTGGCAGACTTGCTTGGAGCCCTGGCGAGGA<br>AAAAGGCGAGCCCTGGAAAGTGAATCAGCTGCACCTGTACTGCACCCTGGACACCAGAATGTGGACCATCGAGGGA<br>ACCCAGCAGGTCGTGGATGAGAAGTCCACCAAGATCACAGAGACACTGACAAAGGCCAAGCAGAAGGACGACCTG<br>AACGACAAGCAGCAGGCCTTCGTGACCAGACAGCAGACACCCTGAACCGGATCAACAATCTGTTCCCCAGACCTA<br>GCAAGAGCAGATACCAGGGCCAGCCTTCTATCCTCGTGGGCGTGTCCTTCGGCCTGGAAAATCCTGTGACACTGGCC<br>GTGGTGGACGTGGTCAAGAATGAGGTGCTGGCCTACAGAAGCGTGAAACAGCTGCTGGGCAAGAACTACAATCTGC<br>TGAACCGGCAGCGGCAGCAGCAACAGAGACTGAGCCACAAGACACAAGGCCCAGAAGAGAAACGCCCCTAACA<br>GCTTCGGCGAGTCTGAGCTGGGCCAGTACGTTGACAGACTGCTGGCTGACGCCATCATTGCCATTGCCAAGACATAC<br>CAGGCCGGCAGCATCGTGATCCCCAAGCTGAGAGACATGAGAGAGCAGATCAGCTCCGAGATCCAGAGCAGAGCC<br>GAGAAGAAGTTCCCCGGCTACAAAGAGGCCCAGCAGAAATACGCCAAAGAATACCGGATGAGCGTGCACCGGTGG<br>TCCTACGGCAGACTGATCGAGAGCATCAAGAGCCAGGCCGCTAAGGCCGGCATCTCTACAGAGATCGGCACCCAGC<br>CTATCCGGGGCTCTCCTCAAGAGAAGGCTAGAGATCTGGCCGTGTTCGCCTACCAAGAGAGACAGGCTGCCCTGAT<br>CTGA |
| TracrRNA<br>(SEQ ID<br>NO: 1220) | TTCACTAATCCGAACCTTGAAAATATAATATTGTTATGATCGCGCCGCAGTTCATGCTCTTTTGAGCCAATGTACTGT<br>GAAAAATCTGGGTTAGTTTGGCGGTTGGAAGACCGTCATGCTTTCTGACCCTGGTAGCTGCCCGCTTCTGATGCTGC<br>CGTCTGTAGAATTCTATAGATGGGATAGGTGCGCTCCCAGCAATAAGGAGTAAGGCTTTTAGCTGTAGCCGTTATTC<br>ATAACGGTGTGGATTACCACAGTGGTGGCTACTGAATCACCCCCTTCGTCGGGGGAATCCTCCCAAATATTTTTTG<br>GCAAATCGAAGCGGGTCAAAAACCCTGGGGACTTGCCAAACTCTGAAAACCCTTGTCCTGTATTGAATCAAGAAA<br>TTAGTGCGTCAATTGATTTACTTTTTTCATTGTCGGCAGAAGCAGCTTTTTAACAGACTTGTCAAATAGACATCTGAA<br>AAGCTTATATAACAAGGGTCTAGGCGGGAACA |
| DR<br>(SEQ ID<br>NO: 1221) | GTTTCAACGACCATCCCGGCTAGGGGTGGGTTGAAAG |
| sgRNA<br>(SEQ ID<br>NO: 1222) | TTCACTAATCCGAACCTTGAAAATATAATATTGTTATGATCGCGCCGCAGTTCATGCTCTTTTGAGCCAATGTACTGT<br>GAAAAATCTGGGTTAGTTTGGCGGTTGGAAGACCGTCATGCTTTCTGACCCTGGTAGCTGCCCGCTTCTGATGCTGC<br>CGTCTGTAGAATTCTATAGATGGGATAGGTGCGCTCCCAGCAATAAGGAGTAAGGCTTTTAGCTGTAGCCGTTATTC<br>ATAACGGTGTGGATTACCACAGTGGTGGCTACTGAATCACCCCCTTCGTCGGGGGAATCCTCCCAAATATTTTTTG<br>GCAAATCGAAGCGGGTCAAAAACCCTGGGGACTTGCCAAACTCTGAAAACCCTTGTCCTGTATTGAATCAAGAAA<br>TTAGTGCGTCAATTGATTTACTTTTTTCATTGTCGGCAGAAGCAGCTTTTTAACAGACTTGTCAAATAGACATCTGAA<br>AAGCTTATATAACAAGGGTCTAGGCGGGAACAGAAATCCCGGCTAGGGGTGGGTTGAAAGNNNNNNNNNNNNNNNN<br>NNNNNNNNN |
| LE<br>(SEQ ID<br>NO: 1223) | TTTATTTTCTTGTATTTATAAGCACATAAGTAAAAATAAGTATTCTATGTATACCTAGTGATATAAGAATACACATAT<br>TTAACAAGATATATGAATAAAATTTTGATAAATTTTCTGTAAAAACAGTGAATATACTTAATTTTTAATTAAATTTTC<br>CAAATTCAGGACTTTCAAGATATTGACATTTCTGTGGTTAGTATTATACCGTCCCAATATTCAGATTCCAAAACATTA<br>GTTTCTCTTCCATTCGCAAATTGAGGAAGCACAGACGGCACAAACCGATAATTATCAGAGTCAAAAATCGACAAAA<br>GGATGATTGAAAAGTGTACATTCGCAAATTAAATGTCGCTTTTCGCAAACAATGTCGCAACTGTATTGATGGCTGA<br>AAGCTACATCGTGTAAATATTATAGGTCATTTATCTCTAAGACAGGCTAATTTGCTTGTTTCGCATATTATATGTCGC<br>ATAATCACGTTTTTGCAAATTAAATGTCGTTTGTTAAAGTTGGTGACTTTTGCAAATTAAATGTCGTATTCTTTATGA<br>ATATATGGTACATTAGTACCTTAATTACTCATGAGTGGGTTTCACTCTATGGCAGAC |
| RE<br>(SEQ ID<br>NO: 1224) | AGTTTCAACGACCATCCCGGCTAGGGGTGGGTTGAAAGACTTAGATAATCAATCCTAGAAAAAACGCTCTTAGTTTA<br>TCCGTCTTTGCGCTACAAAAATCTTGTCAAATGGGGTAGGGTTGAAAGGTGCATCCGACTTGTAAGCGTATTAAACC<br>TTAAAAACATAAAACAAAAAATTAAACTTATTTAATTCTGATTTTTATATGTAAGAATTAGGTTCTGCACAACCA<br>TCAATTCACTTGTTGAAGTAATATTATTGTTGTTAACACTTGCTTGTAAGCAACACTGTAACAATCTAGAAGGAAAAA<br>ACGACATTAATGTGCGAAAACCTAGCATAACTAAATTGATTATAAAAAATAGCCGAAGCGACATCAATTTGAGAAA<br>ACCGACACTAAATTGCGAAAAGCGACATTTAATTTGCGAATGTACAGATTGAAAAGCCAGCAGTCGGATTTGAACC<br>GACGACCTTCCGATTACAAGTCGGATGCACTACCACTGTGCTATGCTGGCAAATTAGGTGATGCGTTTGAATCATTC<br>ACCGATTTCTAATTATAGCACAACAAATTATTTGTCTAGTCCTGATTTGATTTTTCTCTAGGGTTGATGGTTGACTG<br>GAGTTTCTTCTCCCTCCACTTCCCCCACTTCCCCCACTCCCCAGCGTTGCCAAGATGTAGAAATTCTCAAAAATCAGT |

TABLE 27-continued

| Name/ Organism/ System ID (T) | | Sequences |
|---|---|---|
| | | GATGGCAAAACCTCACAAACTTGATAAATTAATAGGCATAGCAAAATCAGCTAGAGCCTAGACTTGAAGAAAAAAC ATTGAGTACAGTTGCCAAACTGTATTTTTTTTGACTAGCAGTATAGAATTGTTCTTTACAGATTCAAAGCATGGCA ACATTGTTTGGACGCGATTTGTTAAGTCTGGCGGACTTGAATCCTACAGAACT |
| KV878783.1/ Spirulina *major* PCC 6313/ T63 | TnsB (SEQ ID NO: 1225) | ATGAACACCGGCAATCAAGAGGCCCACGCCGTGATCACCGACTTCAGCGAGGAAGAACGGCTGAAGCTGGAAGTG ATCCAGAGCCTGATGGAACCCTGCGACCACGCCACATATGGCCAGAAGCTGAAAGACGCCGCTCAGAAGCTGGGCA AGAGCAAGACAACCGTGCAGAGACTGGTGCAGCAGTGGGAAGAAATGGGACTCGCCGCCGTGACATCTAAGGCCA GAGCCGATAAGGGCAAGCACCGGATCTCTCAAGAGTGGCAGGACTTCATCGTGAAAACCTACCGGCTGGGCAACAA GGGCAGCAAGCGGATGAGCAGAAAACAGGTGGCCCTGAGAGTGCAGGCTAGAGCCGCTGAGCTGGGCGAGAAGAT GTACCCCAACGAGCGGACCGTGTACAGAGTGCTGCAGCCTATCATCGAGGCCAAGAACAGAAAAGAGCGTGCG GAGCGCTGGCTGGCGGGGAGATAGACTGAGCGTGAAAAACACGGACCGGCAACGACCTGGTGGTCGAGTACACCAA TCAAGTGTGGCAGTGCGACCACACCTGGGTCGACGTGCTGGTGGTTGACGTGGAAGGCAACATCATCGGCAGACCC TGGCTGACCACCGTGATCGACACCTACAGCAGATGCATCCTGGGCATCAGACTGGGCTTCGATGCCCCTAGTTCTCA GGTGGTGGCTCTGGCTCTGAGACACGCCATGCTGCCTAAGCAGTACCCTCCTACATTCGGCCTGCAGTGCGAGTGGG GCACATACGGCAAGCCCGAGTACTTCTACACCGACGGCGGCAAGGACTTCAGAAGCGAGCACCTGAGACAGATCG GCATCCAGCTGGGGTTTACCTGCGAGCTGAGAGACAGACCTTCTGAAGGCGGAGCCGTGGAAAGACCTTTCGGCAC CCTGAACACCGGAGCTGTTCTCTACCCTGCCTGGCTACACCGGCAGCAACATCCAAGAAAGACCCGAGGACGCCGAG AAGGACGCCAGAATGACACTGAGAGATCTGGAACAGCTGATCGTGCGCTACCTGGTGGACAACTACAACCAGCGGC TGGACAAGAGAATGGGCGACCAGACCAGATACCAGAGATGGGAGTCTGGCCTGCTGGCCACACCAGCTCTGCTGTC TGAGAGACGACTGGACATCTGCCTGATGAAGCAGACCAACCGGTCCATCTACAGAGAGGGCTACATCAGATTCGAG AACCTCATGTACAAGGGCGAGTACCTGGCCGGCTATGTGGGCGAAAGAGTGGTGCTGAGATACGACCCCAGAGACA TCACCACAGTGCTGGTGTACCGGCGCGAGAAGTCCCAAGAAGTGTTCCTGGCCAGAGCTTACGCCCAGGACCTGGA AACAGAGCAGCTGACCCTGGAAGATGCCAAGGCCATCAACAAGAAGATCCGCGAGAAGGGCAAGACCATCAGCAA CCGCAGCATCCTGGACGAAGTGCGGGACAGAGATCTGTTCGTGTCCAAGAAAAAGACGAAGAAAGAGCGCAGAA AGAGGAACAGACCCGGCTGTTCACCCCTGTGCAACCCCTAACAGCAAGCAAGAAACCGAGGAAGAGGAAATCGA GCCCGTCGAGAAGATCGACGAGCTGCCCCAGGTGGAAATCCTGGACTACGATGAGCTGAACGACGACTACGGCTGG TGA |
| | TnsC (SEQ ID NO: 1226) | ATGATGGCCAGCGCCGAGTCTAAGGCCAAAGCTGAAGCTGTGGCTCAGCAGCTGGCAACTTCGAGAAAACCGAA GAGGACCTGGCCAAAGAGATCCAGCGGCTGCGGAGAAGAAACGTGGTGCAGCTGGAACAAGTGAAGCAGCTGCAC AACTGGCTGGAAGGCAAGCGGAGAAGCAGACAGTGCTGTAGAGTCGTGGGGCGAGAGCAGAACCGGCAAGACCATC GGCTGCAACGCCTACAGACTGCGGCACAAGCCCATCAAGAGACAGGCAAGCCTCCTATCGTGCCCGTGGTGTACA TTGAGCCTCCACAGGATTGCGGCAGCATCGACCTGTTCAGAGCCATCATCGAGTACCTGAAGTACAAGGTGCAGAG CCGCGAGAAAGTGCGCGAGCTGAGATCCAGAGCCATGAAGGTGCTGGAACGGTGCCAGGTGGAAACCCTGATCAT CGACGAGGCCGACAGACTGAAGCCCAAGACCTTTGCCGACGTGCGGGACATCTTCGACAAGCGGAATATCAGCGTG GTGCTCGTGGGCACCGACCAGGCTGGACAATGTGATCAAGCGGCGACAAGGTGCACACAGATTCCGGGCCTGCT ACAGATTCGGCAAGCTGACCGGCACCGAGTTCGAGCAGGTTGTGAAGATCTGGGAGAGAGACATCCTGCGGCTGCC CATTCCTAGCAACCTGCACGCCAAGAACATGCTGAAGATCCTCGGACAGGCCACCGGCGGCTATATCGGACTGCTG GATATGATCCTGCGGGAAACCGCCGTCAGAGCCCTGGAAAAAGGCCTGGGCAAGATCAACCTGGAAACACTGAAA GAGGTGGCCGAAGAGTACAGCTGA |
| | TniQ (SEQ ID NO: 1227) | ATGAACGACTGGGAGATCCAGCCTTGGCTGTTCGTGGTGGAACCTTACGAGGGCGAGAGCCTGTCTCACTTCCTGGG CAGATTCAGAAGAGAGAACGATCTGACCCCTGCCGGCCTGGGAAGAGAGGCTGAAATTGGAGCCGTGGTGTCCAG ATGGGAGAAGTTCCGGCTGATCCCATTTCCTAGCCAGAGAGAGCTGGAAAAGCTGGCCCAGGTGGTGCAAGTGGAT GCCGCTAGACTGAGAGTGATGCTGCCTCCTGATGGCGTGGGCATGAAGATGACCCCTATCAGACTGTGCGGCGCCT GCTACAGAGAAGTGCGGTGCCACAGAATGGAATGGCAGTACAAGACCAGCGACCGCTGCGACAAGCACCCTCTGA GACTGCTGAGCGAGTGCCCTAATTGCGGCGCCAGATTTCCCATTCCAAGCCTGTGGCAGGATGGCTGGTGCACCCGG TGCTTTACCACCTTTGGAGAGATGGCCGAGAGCCAGAAACCTCTGTGA |
| | Cas12k (SEQ ID NO: 1228) | ATGGTGGTCATGAGCCAGATCACCATCCAGTGCAGACTGGTGGCCAGCGAGGCTACAAGACAGGTGCTGTGGACAC TGATGGCCGAGAGAAACACCCCCTCTGATCAACGAGCTGCTGGCCCAGATGGCCCAGCATCCTGATCTTGAAGAGTG GCGGCAGAAGGGCAAGCCTACACCTGGCGTTGTGAAGAAGCTGTGCGACCCTCTGAGACAGGACCCCAGATTCATG GGCCAGCCTGGCAGATTCTACAGCAGCGCTATTGCCCTGGTCGAGTACATCTACAAGAGCTGGCTGAAGCTGCAGC AGAGACTGCAGAGAAAGCTGGAAGGCCAGCAGATGCCTGGCCATGCTGAAGTCTGACCCCGAGCTGTGTGAAG AGAACCACTGCACCCTGGACACCCTGAGAGATAAGGCCGCCGAGATTCTGGCCTCTCTGGAAAGCCCTCCAGCCTAA GCAGGGCAAAGTCAAGACCAAGAAGGCCAAGGCTCAGAGCAGCCCCAGACAGAGCCTGTTCGAAATGCATGACGG CGCCGAGGACGGCTTCGTGAAAAGCGCCATTGCCTACCTGCTGAAGAACGGCGGCAAGCTGCCTACACACGAAGAG GACCCTAAGAAGTTCGCCAAGCGGCGGAGAAAGGCCGAAGTGAAGGTGGAAAGACTGATCCACCAGATTACCGCC AGCCTGCCTAAGGGCAGAGATCTGACAGGCGAACGGTGCTGGAAACCCTGCTGACAGCCAGCTATACAGCCCCTA AGGATGCCCAGCAGACAAAGTGTGGCAGAGCATCCTGCTGACCAAGACAAAGGCCGTGCCTTATCCTATCCAACTA CGAGACAAACGAGGACCTGACCTGGTCAAGAACGAGAAGGGCAGACTGTGCGTGCGGTTCAATGGCTGAGCGA GCACACCTTCCAGATCTACTGCGACCAGAGACAGCTGAAGTGGTTCCAGCGGTTCTACGAGGATCAAGAAGTGAAG CGGACCAGCAAGAACCAGCACAGCACCAGCTGTTTACCCTGCGGAGCGGAAGAATCGTGTGGCAAGAGAGCGAC CGGACAGCAAGCCTTGGACGCCAATCATCACCACCCCTGTGCTGTACCCTGGATACCAGACTTTGGAGCGCCGAGG GCACAGAGGAAGTGCGGACAGAAAAGGCCATCGATATCGCCAAGCACTGACCAACATGAATGAGAAGGGCGACC TCAACGATAAGCAGCAGGCCTTCATCAAGAGAAAGACCGCCACACTGGACCGGATCAACAACCCCTATCCTCGGCC TAGCAAGCCCTGTATCACGGCCAGTCTCATCATCCTCGTGGGAGTTGCCCTGGGCCTTGATAAGCCTGCTACAGTGG CTGTGGTGGATGGCACAACAGGCAAGGCCATCACCTACCGGAACCTGAAACAGCTGCTGGGCGAGAACTACAAGCT GGTCAACAGACAGCGGCAGCAGAAGCAGGCCCAGGCCCATGCATCAGAACACAAAGCCCAGAAAGAAGAAGCGGCACCG ACCAGTTCGGAGATTCTGAGCTGGGACAGCACATCGACCGGCTGCTGGCTAAAGCCATCGTGGCCTTTGCTCACTCT CAGAGCGCCGGCTCTATCGTGGTGCCCAAACTGGAAGATATCCGCGAGATCGTGCAGAGCGAGATCCAGGCCAGAG CCGAGGAAAAGGTGCCAGGCTATATCGAGGGCCAGAAGCAGTACGCCAAGAGATACAGAGTGCAGGTCCACCAGT GGTCCTACGGCAGACTGATCGACAGCATCAAGAGCAAGGCCACACAGCAGCAGGTCGTGATCGAAGAGGGAAAGC AGCCTGTGCGGGGATCTCCTGAAGCTCAGGCTACAGAACTGGCCATCAGCACCTACCACCTGAGAGCCTCTAGCTG A |

TABLE 27-continued

| Name/<br>Organism/<br>System<br>ID (T) | | Sequences |
|---|---|---|
| | TracrRNA<br>(SEQ ID<br>NO: 1229) | GAAAGAAATCCGCCACTTTCCGTACCTTGACAATAGAATAGAGATAATCGCGCCGTAGGTCATGTTCTTTCAGAACC<br>GCTGAACTACGAAAAATATGGGCTAGTTTGCTTGTTTGACAGCAAGTGTGCTTTCTGGCCCTGGTAGCTGTCCGCCC<br>TGATGCTGATTTCTGCACACCTTAATAGCAGAAATGATTAACTTGAGAAATGAAACGCTTGTGCCTTCATTTTACGA<br>GGTCGGTGCGCTCCCAGCAATAAGAGTGTGGGTTTACCACAGTGATGGCTACCGAATCACCCCCGACCAAGGGGGA<br>ATCCACCCCAATCTTCTCATTTCTGGCGTATACGAAGCGGGGTCAAAATCCCCAAGAGGTTCGCCAAAATGGGAAA<br>CCCCTTTCTCAATCTGCTTTCTAGGCTTTTGATCTGGTCTTTCAGGGCAGTTAACCCAAAGCCAACAGCGACGTTTCC<br>GGCAGATCTGCCAAAACTGAGGTGGGAAAGCAGTCTGGATAAGGCTTCACCAGGGAGCG |
| | DR<br>(SEQ ID<br>NO: 1230) | GTTTCAATGACCATCCCACGTTGGGATGGATTGAAAG |
| | sgRNA<br>(SEQ ID<br>NO: 1231) | GAAAGAAATCCGCCACTTTCCGTACCTTGACAATAGAATAGAGATAATCGCGCCGTAGGTCATGTTCTTTCAGAACC<br>GCTGAACTACGAAAAATATGGGCTAGTTTGCTTGTTTGACAGCAAGTGTGCTTTCTGGCCCTGGTAGCTGTCCGCCC<br>TGATGCTGATTTCTGCACACCTTAATAGCAGAAATGATTAACTTGAGAAATGAAACGCTTGTGCCTTCATTTTACGA<br>GGTCGGTGCGCTCCCAGCAATAAGAGTGTGGGTTTACCACAGTGATGGCTACCGAATCACCCCCGACCAAGGGGGA<br>ATCCACCCCAATCTTCTCATTTCTGGCGTATACGAAGCGGGGTCAAAATCCCCAAGAGGTTCGCCAAAATGGGAAA<br>CCCCTTTCTCAATCTGCTTTCTAGGCTTTTGATCTGGTCTTTCAGGGCAGTTAACCCAAAGCCAACAGCGACGTTTCC<br>GGCAGATCTGCCAAAACTGAGGTGGGAAAGCAGTCTGGATAAGGCTTCACCAGGGAGCGAAATCCCACGTTGGG<br>ATGGATTGAAAGNNNNNNNNNNNNNNNNNNNNNNNN |
| | LE<br>(SEQ ID<br>NO: 1232) | TTGGCGTGGTCGATCAGTTCTGAACTGTCTGCCCCCACACTGCCCCCAAAATCTTGATTTTAATGACATTTTTTTTCC<br>AATTTTAGGGTGTGGGTGTCGATTGACTCATTAACTGACATCTTGACAAATTATTTGTCATTGCTATAGACAAGCCTG<br>CAACCCTTTACTATACATAAGGTTGTGGGCTTTTTGCATTGGAAATTTACTCAAAAGCAAAATTGACAAATTAGGTGTC<br>GTATATTAGGAGTTTGCCAAAATATGTGTCGCTTTTCATTTAGTCCAGATTTTCTGGCTTTTTGACACATTCTGTGTC<br>GCTCAGGGTAAAATAACAACATGTTTGTATTAAACACATTTGTTGTAAATGAATACAGGTAATCAAGAAGCTCATGC<br>AGTTATCACTGACTTCTCTGAGGAGGAGAGGGTTAAAACTAGAAGTTATCCAGAGTTTGATGGAACCCTGTGATCACG<br>CTACCTATGGACAAAAGTTAAAAGATGCGGCTCA |
| | RE<br>(SEQ ID<br>NO: 1233) | GTTGCTGAAACCATCCCAAGGTGGGATTAGGTTGAAAGAGTAATACAAGAATTGGGTGGATTGAAAGCAAGTCCCA<br>CCGTCCCCTACTTTAGTGCAATGCAAGATTACACAACAAACTTGCTCTGAATGTATGGAAGGTTCGTAAAAGTGGTG<br>ACAAATTTGTCAAGATGACATCAATTTGACAACGATGACAAATAATTAGTCAATCGACATGTGGGCAACACCG<br>TCAGAACAACTCAGAAAACTCTGAAACGATGGGGGTGGTGGGACTTGAACCCACACGTCTTTTTACGGACAACGGA<br>TTTTAAGTCCGCAGCGTCTACCATTCCGCCACACCCCAAGAGCAGTGACAGGGTTCTAGTTTAGCAGCAAATGGCG<br>GCCACTGCATGGAACAGAACCCTCAGAAAATCTAATCAATCTGCCTCTTGCGCTCCGATGGGTTGAATTGTTTATGA<br>TGGGAGGGCGTTTGCTACTGCGTTGGTGACTGCCAATATCG |
| RSCM01000009.1/<br>Trichormus<br>variabilis<br>SAG 1403-4b/<br>T64 | TnsB<br>(SEQ ID<br>NO: 1234) | ATGCTGGAAACCCAGGACAACAAGCCCAACGACGACGAAGTGAAGGGCAGCGACATCATCACCGAACTGTCTGCC<br>GGCGACAAAGAGCTGCTGGAACTGATCCAGAAGCTGCTCGAGCCCTGCGACAGAACCACATACGGCGAGAGACAG<br>AGAGAGGTGGCCGCCAAGCTGGGAAAGTCTGTGCGGACAGTTAGACGGCTGGTCAAGAAGTGGGAAGAACAGGGA<br>CTTGCCGGCCTGCAGAACCCCAGAGAGCCGATAAGGGCAAGCACCGGATCGATAGCCAGTGGCAGAAGTTCATCA<br>TCAACACCTACAAAGAGGGCAACAAGGGCAGCAAGCGGATCACCCCTCAGCAGGTTGCCATTAGAGTGCAGGCCA<br>AAGCCGCTGAGCTGGGCGACGAGAATTACCCCAGCTACCGGACCGTGTACAGAGTGCTGCAGCCCATCATCGAGGA<br>ACAAGAGCAGAAGGCCGGCGTCAGAAACAGAGGCTGGCGAGGCTCTAGACTGAGCCTGAAAACCAGAGATGGCCT<br>GGACCTGAGCGTGGAATACTCCAACCACATCTGGCAGTGCAGCACACCAGAGCCGATCTGCTGCTGTTGATCAG<br>CACGGCGAACTGCTGGCCAGACCTTGGGTCACCACAGTGATCGACACCTACACCGGTGCATCATCGGCATCAACC<br>TGGGCTTTGATGCCCCTAGCTCTCAGGTGGTGGCTCTGGCTCTGAGACACGCCATCCTGCCTAAGAAGTACGGCAGC<br>GAGTACGACCTGCACGAGGAATGGGGCACATATGGCAAGCCCGAGCACTTCTTTACCGACGGCGGCAAGGACTTCA<br>GAAGCAACCATCTGCAGCAGATTGGCGTGCAGCTGGGCTTCGCCTGCCATCTGAGAGATAGACCTAGCGAAGGCGG<br>CATCGTGGAAAGACCTTTCGGCACCCTGAACACCGACCTGTTTTCTGCCCTGCCTGGCTACACCGGCAGCAACGTGC<br>AAGAAAGACCTGAGGAAGCCGAGAAGAGGCCTGTCTGACCCTGAGAGAGCTGGAAAGACTGATCGTGCGGTACA<br>TCGTGGACAAGTACAACCAGAGCATCGACGCCAGACTGGGCGATCAGACCCGGTATCAGAGATGGGAGGCCGGAC<br>TGATTGTGCCCCTAGCCTGATCAGCAGAAGGACCTGAGAATCTGCCTGATGAAGCAGATCCGGCGGAGCATCTA<br>CAGAGGCGGCTATCTGCAGTTCGAGAACCTGACCTACCGGGGCGAAAATCTGGCCGGATATGCCGGCGAAAGCGTG<br>GTGCTGAGATTCGACCCCAAGGACATCACCACCATCCTGGTGTACAGACAGACCGGCAGCCAAGAAGAGTTCCTGG<br>CCAGAGCCTACGCTCAGGACCTGGAAACCGAAGAACTGTCCCTGGATGAGGCCAAGGCCATGAGCAGAAGAATCC<br>GGCAGGCCGGAAAAGAGATCAGCAACAGATCCATCCTGACCCTGGACGTGCGGGACCGCGAGACATTCGTGAAGCAGA<br>AAAAGACCAAGAAAGAGCGCCAGAAAGAGGAACAGGTCGTCGTCGAGAAAGTGAAGAAACCCGTGATCGTGGAA<br>CCCGAAGAGATCGAGGTGGCCAGCGTGAAACAGTGTCCGAGCCTGATATGCCCGAGGTGTTCGACTACGAGCAGA<br>TGCGCGAGGACTACGGCTGGTAA |
| | TnsC<br>(SEQ ID<br>NO: 1235) | ATGACATCTCAGCAGGCCGAGTCTGTGGCCCAAGAGCTGGGAGACATCCCTCAGAACGACGAGAAGCTGCAGGCCG<br>AAATCCAGCGGCTGAACAGAAAGAGCTTCATCCCTCTGGAACAAGTGAAGATGCTGCACGACTGGCTGGACGGCAA<br>GAGACAGAGCAGACAGTCTGGCAGAGTGCTGGGCGAGAGCAGAACCGGCAAGACCATGGGCTGTGACGCCTACAG<br>ACTGCGGCACAAGCCTAAGCAAGAGCCCGGCAAACCTCCTACAGTGCCCGTGGCCTACATCCAGATTCCTCAAGAG<br>TGCAGCGCCAAAGAGCTGTTCGCCGCCATCATCGAGCACCTGAAGTACCAGATGACCAAGGGCACCGTGGCCGAGA<br>TCAGAGACAGAACCCTGAGAGTGCTGAAGGATGCTGCCGTGGAAATGCTGATCATCGACAGGCCGAGCGGTTCAA<br>GCCCAAGACCTTTGCTGAAGTGCGGGACATCTTCGACAAGCTGGAAATCGCCGTGATCCTCGTGGGCACCGATAGA<br>CTGGATGCCGTGATCAAGCGGGACGAACAGGTGTACAACCGGTTCAGGGCCTGCCACAGATTTGGCAAGTTCAGCG<br>GCGAGGACTTCAAGCGGACCGTGGAAATCTGGGAGAAACAGGTGCTGAAGCTGCCTGTGGCCAGCAACCTGTCTAG<br>CAAGGCCATGCTGAAAACCCTGGGCGAAGCCACAGGCGGCTATATCGGACTGCTGGACATGATCCTGAGAGAGAGAC<br>GCCATTCGGGCCCTGAAGAAGGGCCTGTCTAAGATCGACCTGGAAACCCTGAAAGAAGTGACCGCCGAGTACAAGT<br>GA |
| | TniQ<br>(SEQ ID<br>NO: 1236) | ATGGAAGTGGGCGAGATCAACCCATGGCTGTTCCAGGTGGAACCCTATCCTGGCGAGAGCCTGTCTCACTTCCTGGG<br>CAGATTCAGACGGGCCAACGATCTGACCACAACCGGCCTGGGAAAAGCCGCTGGTGTTGGCAGGTTGGCCAGA<br>TGGGAGAAGTTCAGATTCAACCCTCCACCTAGCCGGCAGCAGCTGGAACCGTGGCTAAAGTCGTGGGAGTCGACG<br>CCGATAGACTGGAACAGATGCTTCCTCCTGCCGGCGTGGGCATGAACCTGGAACTATTAGACTGTGCGCCGCCTGC<br>TACGTGGAAAGCCCTTGCACAGAATCGAGTGGCAGTTCAAAGTGACCCAGGGCTGCCAGCACCACCACCTGTCTC<br>TGCTGAGCGAGTGCCCTAATTGCGGCGCCAGATTCAAGGTGCCAGCTCTGTGGGTTGACGGCTGGTGCAGAGATG<br>CTTTCTGCCCTTTGGCGAGATGGTGGAACACCAGAAGGGCATCTGA |

TABLE 27-continued

| Name/<br>Organism/<br>System<br>ID (T) | | Sequences |
|---|---|---|
| | Cas12k<br>(SEQ ID<br>NO: 1237) | ATGAGCCAGATCACCATCCAGTGCAGACTGGTGGCCAGCGAGAGCACAAGACAGCAGCTGTGGCAGCTGATGGCC<br>GAGAAGAACACCCCTCTGATCAACGAGCTGCTCAGCCAGATCGGAAAGCACGCCGAGTTTGAGACATGGCGGCAG<br>AAGGGCAAACACCCCACCGGCATTGTGAAAGAGCTGTGCGAGCCCCTGAAAACAGACCCCAGATTCATGGGCCAGC<br>CTGCCAGATTCTACACCAGCGCTACCGCCAGCGTGAACTACATCTACAAGAGTTGGTTCGCCCTGATGAAGCGGTTC<br>CAGAGCCAGCTGGATGGCAAGCTGAGATGGCTGGAAATGCTGAACAGCGACGCCGAGTCGGTGGAAGCTAGCGGA<br>GTGTGTCTGGATGTGCTGCAGACAAAGAGCGCCCAGATCCTGGCTCAGTTCGCCCCTCAGAATCCTGCCGAAACACA<br>GCCCGCCAAGGGCAAAAAGACCAAGAAAGGCAGAAGAAGTCCCCTACCAGCGACAGCGAGAGAAACCTGAGCAAGA<br>ACCTGTTCGACGCCTACAGCAACACCGAGGACAACCTGACCAGATGCGCCATCTCCTACCTGCTGAAGAACGGCTG<br>CAAGATCAGCAACAAGGCCGAGAATCCCGACAACTTCGTGCAGCGGCGGAGAAAGGTGGAAATCCAGATCCAGCG<br>GCTGACCGAGAAGCTGGCCGCCAGAATTCCTAAGGGCAGAGATCTGACCAACACCATCCGGCTGGAAACCCTGTTC<br>AACGCCACACAGACCGTGCCTGAGAACGAGACAGAGGCCAAGTTCTGGCAGAACATCCTGCTGCGGAAGTCCAGCC<br>AGCTGCCTTTTCCAGTGGCCTACGAGACAAACGAGGACCTCGTGTGGTTCAAGAATCAGTTCGGCCGGATCTGCGTG<br>AAGTTCAGCGGACTGAGCGAGCACACCTTCCAGATCTACTGCGACAGCAGACAGCTGCAGTGGTTCCAGCGGTTCC<br>TTGAGGACCAGCAGATCAAGAAGAACTCCAAGAACCAGCACAGCAGCGCCCTGTTCACACTGAGAAGCGGCAGAA<br>TCAGCTGGCAAGAGGAACAAGGCAAGGGCGAGCCCTGGAACATCCACCACCTGACACTGTACTGCAGCGTGGACA<br>CCAGACTGTGGACCGAAGAGGGCACCAACCTGGTCAAAGAAGAAGGCCGAGGAAATCGCCAAGACAATCACCC<br>AGACCAAGGCCAAAGGCGACCTGAACGATAAGCAGCAGGCCCACCTGAAGAGAAAGAACAGCAGCCTGGCCAGAA<br>TCAACAACCCATTTCCTAGACCTAGCCAGCCTCTGTACAAGGGCCAGAGCCATATCCTCGTGGGAGTGTCACTGGGC<br>CTCGAGGATCCTGCCACAATTGCTGTGGTGGACGGCACCACAGGCAAGGTGCTGACCTACCGGAACATCAAACAGC<br>TGCTCGGCGACAACTACAAGCTGCTGAACCGGCAGCGGCAGCAGAAACATCTGCTGAGCCACCAGAGGCACATTGC<br>CCAGAGAATGAGCGCCCCTAACCAGTTCGGCGATTCTGAGCTGGGCGAGTACATCGACCGGCTGCTGGCCAAAGAG<br>ATCATTGCTATCCGCCCAGACCTACAAGGCCGGCAGCATCGTGATTCCCAAGCTGGGAGACATGAGAGAGCAGATCC<br>AGTCCGAGATCCAGAGCAAGGCCGAACAGAAGTCCGACATCATCGAGGTGCAGCAGAAGTACGCCAAAGAATACC<br>GGACCACCGTGCACCAGTGGTCTTACGGCAGACTGATCGCCAACATCCAGTCTCAGGCCGCCAAGACCGGAATCGT<br>GATCGAGGAAGGCAAGCAGCCCATCCGGGCCTCTCCACAAGAGAAAGCCAAAGAGCTGGCCATTAGCACCTACCA<br>GAGCCGGAAAGCCTGA |
| | TracrRNA<br>(SEQ ID<br>NO: 1238) | TTGACAAAATACCGAACCTTGATAATAGAATAGTAATTAACAATAGCGCCGCAGTTCATGTTTTTAATAAACCTCTG<br>TCCTGTGATAAATGCGGGTTAGTTTGACTGTTGTGAGACAGTCGTGCTTTCTGACCCTAGTAGCTGCCCACCTTGATG<br>CTGCTGTTTCTAGTAAACAGGAATAAGGTGCGCCCCCAGTAATAGAGGTGCGGGTTTACCGCAGTGGTGGCTACCG<br>AATCACCTCCGAGCAAGGAGGAATCCACCTTAATTATTTATTTTTGGCGAACCATAAGCGAGGTCAAAAACCCTGG<br>GGTTCTGCCAAAAGTCCAAATCCCTTGTCTAATCTGTGTTTCGGATGTTTAGATGCTTCAATAATTCTCTTTTGAGAG<br>GAAAATTTAGAGCAGATTTAGGACATTCGCCAAAATTGCTTTTGGAAGTGTCTTCAGATAAGGGTTTGGTCGGGCGG<br>A |
| | DR<br>(SEQ ID<br>NO: 1239) | GTTTCAACACCCCTCCCGAAGTGGGGCGGGTTGAAAG |
| | sgRNA<br>(SEQ ID<br>NO: 1240) | TTGACAAAATACCGAACCTTGATAATAGAATAGTAATTAACAATAGCGCCGCAGTTCATGTTTTTAATAAACCTCTG<br>TCCTGTGATAAATGCGGGTTAGTTTGACTGTTGTGAGACAGTCGTGCTTTCTGACCCTAGTAGCTGCCCACCTTGATG<br>CTGCTGTTTCTAGTAAACAGGAATAAGGTGCGCCCCCAGTAATAGAGGTGCGGGTTTACCGCAGTGGTGGCTACCG<br>AATCACCTCCGAGCAAGGAGGAATCCACCTTAATTATTTATTTTTGGCGAACCATAAGCGAGGTCAAAAACCCTGG<br>GGTTCTGCCAAAAGTCCAAATCCCTTGTCTAATCTGTGTTTCGGATGTTTAGATGCTTCAATAATTCTCTTTTGAGAG<br>GAAAATTTAGAGCAGATTTAGGACATTCGCCAAAATTGCTTTTGGAAGTGTCTTCAGATAAGGGTTTGGTCGGGCGG<br>AGAAATCCCGAAGTGGGGCGGGTTGAAAGNNNNNNNNNNNNNNNNNNNNNNNN |
| | LE<br>(SEQ ID<br>NO: 1241) | ATCGCTCTTTCCCTATCAAATTATACTAGAAAAGTGAATCTTCCTGTGCTGATAACAACAACATAAACTGCTTCCC<br>CTGACCTGAAGGTTTCAACGGTTCCTAGAAGACCAAGAAATTAATAAAATAGTAAAAATCAACATTCTAGTGCTT<br>TGTTTACCATGCATAGTGGTCGTATCGCTTGGCAGGACGAACAAGGCAAGTGAGAACCCTGGAATATTATTTTGTCG<br>CTTGTCAAATTAAATGACCACTTGACAAATTAATGTCCACAAATATATTAACCGCTAAACCCTTACACAGTGAGGGT<br>TTTAATATTTTAGCCTATTTTTAGCCAGTCAGATACTAATTGACAAAATAACTGTCCGAACTTGAATATTTGACAAAT<br>TAATTGTCCTGTATTGAAAATCCCTATTTTTCCAATTTTTCCAGACTTGACAAATTAATTTGTCCTTTTATACAGTACA<br>ATACAACTATGTTTGTAATAAACATATATGCTAGAAACTCAAGATAATAAAACCCAATGATGATGAGGTAAAAGGTAG<br>TGACATTATCACCGAACTATCCGCAGGTGATAAGGAACTATTGGAACTAATCAAAAATT |
| | RE<br>(SEQ ID<br>NO: 1242) | GTTTCAACACCCCTCCCGAAGTGGGGCGGGTTGAAAGTCTAAATTTTGTCTTCTGTTTCAGAGCCTAATAAATTAAA<br>ACACTGTTATAAAATTAAGGTGGGTTGAAAGGAGTGCTGCGATCGTACACAACATAAGTTATGTGTATTACCTGGA<br>GATAAAATTTAAGGACAAATAATTTGGCAGCACGGACAGCAGCCAATTTGGCAAGACGGACAACAATTTGTCAACGCGGA<br>CAAATTATTTGGCAAGTGACAACAATTTATAATGGAGAATAGGAGACTCGAACCCCTGACCTCTGCGGTGCGATCG<br>CAGCACTCTACCAACTGAGCTAATTCCCCTTGTGAGTGCAGAGTAGCAAACTCTGACAGACGTACTCTATCTTAACA<br>CTCAGGCACGGCAGATTTTACATCTTTTTGCAAATACACCTGCTGCACCCGTTCCAATTCAAATCAGTCAAATAAT<br>CTACAGTCCAGTTGGCTTGACGCTGAAGCATATGAAAAGGG |
| CP012036.1/<br>Nostoc<br>piscinale<br>CENA21/<br>T65 | TnsB<br>(SEQ ID<br>NO: 1243) | ATGCCCGACAAAGAGTTTGGACTGACCGGCGAGCTGACCCAAGTGACAGAAGCCATCCTGCTGGGCGAGAGCAACT<br>TCGTGGTGGACCCCTGCACATCATCCTGGAAAGCAGCGACAGCCAGAAGCTGAAGTTCAACCTGATCCAGTGGCT<br>GGCCGAGTCTCCCAACAGACAGATCAAGAGCCAGCAGCGGAAGCAGCCGTGGCCGAGACACTGAGCATCAGCACAG<br>ACAGGTGGAACGGCTGCTGAAAGAGTACAACGAGGACGGCTGAACGAGACAGCTGGCCTGCAGAGAAGCGACAA<br>GGGCAAGCACAGAGTGTCCGAGTACTGGCAGCAGTACATCAAGACCATCTACGAGAACAGCCTGAAAGAGAAGCA<br>CCCTATCAGCCCCGCCTCTGTCGTGCGGGAAGTGAAGAGACACGCCATCGTGGATCTGGGACTCGAGCAGGGCGAT<br>TACCCTCATCCTGCCACCGTGTACCGGATCCTGAATCCTCTGATCGAGCAGCAGCAGCGGAAGGAAGAAGATCAGAA<br>ACCCTGGCAGCAGCTGGCTGACCGTGGAAAACAAGAGATGGCAAGCAGCTGAAGGCCGAGTTCAGCAACCAGA<br>TCATCCAGTGCGACCACACCGAGCTGGACATCGGATCGTGGACAACAATGGCGTGCTGCTGCCCAAAGACCTTG<br>GCTGACAACCGTGGTGGATACCTTCAGCAGCTACGTGCTGGGCTTTCACCTGTGGATCAAGCAGCCTGGAAGCGCC<br>GAAGTTGCCCTGGCTCTGAGACACGACATCCTGCCTAAGCAGTACCCCAACGACTACGACCTGAGCAAGCCTTGGA<br>GCTACGGCCCTCCATTCCAGTACTTTTCACCGACGGCGGCAAGGACTTCAGATCCAAGCACCTGAAAGCCATCGGC<br>AAGAAACTGGGATTTCAGTGCGAGCTGCGGGACAGACCTAATCAAGGCGGCATCGTGAACGGATCTTTAAGACCA<br>TCAACACCCAGGTGCTGAAGGACCTGCCTGGCTACACAGGCAGCAACGTGCAAGAGAGGCCTGAGAACGCCGAGA<br>AGAGGCCTGTCTGACCATCCAGGACATCGACAAAGTGCTGGCCGGCTTCTTCTGCGACATCTACAACACGAGCCT<br>TATCCTAAGGACCCCAGAGACACCAGATTCGAGAGATGGGTCAAAGGCATGGGCAGAAAGCTGCCCGAGCTCTGG |

TABLE 27-continued

| Name/<br>Organism/<br>System<br>ID (T) | Sequences |
|---|---|
| | ATGAGAGAGAGCTGGATATCTGCCTGATGAAGGAAGCCCAGAGAGTCGTTCAGGCCCACGGCAGCATCCAGTTCGA<br>GAACCTGATCTACAGAGGCGAGAGCCTGAAGGCCTACAAGGGCGAGTACGTGACCCTGAGATACGACCCCGATCAC<br>ATCCTGACAGTGTACGTGTACAGCTGCGAGAGCGACGACAACCTGGAGAGTTTCTGGGCTACGCCCACGCCATCA<br>ACATGGACACACGACCTGTCTCTGGAGAACTGAAGGCCCTGAACAAAGAGCGGAGCAAGGCCCGGAAAGAGC<br>ACTTCAATTACGACGCCCTGCTGGCCCTGGGCAAGAGAAATGAACTCGTGGGCAAACGCAAAGAGGACAAGAAAG<br>AGAAACGGCGGAGCGAGCAGAAGAGACTGAGATCCACCAGCAAGAAAAACTCCAACGTGGTGAACTGAGAAAG<br>AGCAGAGCCGCCAGCAGCTCCAAGAAGAGATGA |
| TnsC<br>(SEQ ID<br>NO: 1244) | ATGGCCCAGATCTCAGCTGGCCACACAGCCCATCGTTGAAGCCCTGGCTCCTCACCTGTCTCTGAAGGCCCAGATCGC<br>CAAGACCCATCGACATCGAGGAAATCTTCCGGACCTGCTTCATCACCACCGACAGAGCCAGCGAGTGCTTCAGATGG<br>CTGGACGAGCTGCGGATCCTGAAGCAGTGCGGCAGAATCATCGGCCCCAGAAACGTGGGCAAGAGCAGAGCTGCC<br>CTGCACTACAGAGATGAGGACAAGAAACGGGTGTCCTACGTGAAGGCTTGGAGCGCCAGCAGCAGCAAGAGACTG<br>TTCAGCCAGATTCTGAAGGACATCAACCACGCCGCTCCTACCGGCAAGAGACAGGATCTCAGACCTAGACTGGCCG<br>GCAGCCTGGACTGTTCGGACTGGAACTGGTCATCATCGACAACGCCGACAACCTGCAGAAAGAGGCCCTGCTGGA<br>CCTCAAGCAGCTGTTCGAGGAATGCCACGTGCCAATCGTGCTCGTCGGCGAAAAGAGCTGGACGACATTCTGCAG<br>GACTGCGACCTGCTGACCAACTTTCCCACACTGTACGAGTTCGAGCGGCTGGAATACGACGACTTCAAGAAAACCC<br>TGAGCACCATCGAGCTGGATATCATCAGCCTGCCTGAGAGCAGCAACCTGAGCGAGGGCAACATCTTCGAGATCCT<br>GGCTGGCTCTACAGGCGGCAGGATGGGCATCCTGGTCAAGATCCTGACAAAGGCCGTGCTGCACAGCCTGAAGAAC<br>GGCTTCTCTAAGGTGGACGAGAGCATCCTGGAAAAGATCGCCAGCAGATACGGGACCAAGTACATCCCTCTGGAAA<br>ACCGGAACCGGAACGAGTGA |
| TniQ<br>(SEQ ID<br>NO: 1245) | ATGCTGGTGGTTATGGTGCAGAACATCTTCCTGAGCAAGACCGAGATCGGCATGAACGAGGACGAGATCAGACCCA<br>AGCTGGGCTACGTGGAACCTTACGAGGGCGAGAGCATCAGCCACTACCTGGGCAGACTGCGGAGATTCAAGGCCAA<br>CTCTCTGCCCAGCGCCTACAGCCTGGGAAAGATTGCTGATCTGGGCGCCGTGACAGGCAGATGGGAGAAGCTGTAC<br>TTCAACCCCAGACCTACACAGCAAGAGCTGGAAGCCCTGGCCTCTGTGGTGGCCGTGAATGCCGATAGACTGACCG<br>AGATGCTGCCTCCTACCGGCATGACCCTGAAGCCTAGACCTATCAAGCTGTGCGCCGCCTGCTATGCCGAGGAACCC<br>TATCACAGAATCGAGTGGCAGTACAAAGAACAGCAGAAATGCGTGCGCACAACCTGCGGCTGCTGACCAAGTGC<br>ATCAACTGCGAGACACCCTTTCCTATACCTGCCGACTGGGTGGAAGGCGAGTGTCCTCACTGTAGCCTGAGCTTCGC<br>CAAGATGGCCAAGCGGCAGCGGAGAAACTAA |
| Cas12k<br>(SEQ ID<br>NO: 1246) | ATGAGCGTGATCACCATCCAGTGCAGACTGGTGGCCGGCGAGGATACCCTGAGAACACTGTGGGAACTGATGGCCG<br>ACAAGAACACCCCTCTGGTCAATGAGCTGCTGGCCCAAGTGGGAAAGCACCCCGAGTTTGAGCCCTGGCTGGAAAA<br>GGGCAAGATCCCCACCGAGTTTCTGAAAACCCTGGTCAACAGCCTCAAGACCCAAGAGGAGATTCGCCGACCAGCCT<br>GGCAGATTCTACACCTCTGCCATTGCTCTGGTGGACTACGTGTACAAGAGTTGGTTCGCCCTGCAGAAGCGGCGGAA<br>GAGACAGATCGAGGGCAAAGAGAGATGGCTGACCATCCTGAAGTCCGACCTGCAGCTGGAACAAGAGTCCCAGTG<br>CAGCCGGAAGTCTAAAAAGACCAAGAAGTCGCCAAGCTGCGAAGTCCAGCCTGTTCCAGATCCTGCTGAACACC<br>TACGAGCAGACTCAAGAGACACTGACCCACTGCGCCATTGCCTACCTGCTGAAGAACAACTGCCAGATCAGCGAGC<br>TGGAAGAGGACAGCGAGGAATTCACCAAGAACCGCCGGAAGAAAGAGATTGAGATCGAGCGGCTGAAGGATCAGC<br>TGCAGAGCAGAATCCCCAAGGGCAGAGATCGAAGGGCGAAGAGTGGCTGAAAACACTGGAAATCAGCACCGCCA<br>ACGTGCCCCAGAACGAGAATGATGCTAAGGCCTGGCAGGCCGCTCTGCTGAGAAAATCTGCCGACGTGCCATTTCC<br>TGTGGCCTACGAGAGCAACGAGGACATGACCTGGCTGCAGATTGGGAAAGGGCAGACTGTTCGTGCGGTTCAACGGC<br>CTGGGCAAGCTGACATTCGAGATCTACTGCGACAAGCGGCATCTGCACTACTTCACCCGGTTTCTGGAAGATCAAGA<br>GATCAAGCGGAACAGCAAGAATCAGTACAGCAGCTCCCTGTTCACCCTGCGGAGTGGTAGACTTGCTTGGAGCCCA<br>GGCGAAGATAGAGGCGAGCCCTGGAAAGTGAACCAGCTGCACCTGTACTGCAGCCTGGACACCAGAATGTGGACC<br>ATCGAGGGAACACAGCAGGTCGCCGATGAGAAAAGCACCAAGATCACCGAGACTCTGACAAAGGCCAAGCAGAAG<br>GACGAGCTGACAAGCAGCAGGCCCTTCATCACCAGACAGCAGAGCCTCCTGGACCGGATCAACAACCCATTTC<br>CTCGGCCTAGCAAGCCCAACTACCAGGGCCAGCCTTCTATCCTCGTGGGCGTGTCCTTTGGCCTGGAAAAGCCTGTG<br>ACAGTGGCCGTGGTGGACGTGATCAAGAACGAGGTGCTGGCCTACAGAAGCGTGAAACAGCTGCTGGGCAAGAAC<br>TACAATCTGCTGAACCGGCAGCGCCAGCAGCAGAGACTGTCTCACGAGAGACACAAGGCCCAGAAGCGGAAC<br>GCCCCTAATAGCTTTGGCGAGTCTGAGCTGGGCCAGTACGTGGACAGACTGCTGGCTGATGCCATCCTGGCCATTGC<br>CAAGACATACCAGGCCAGCTCCATCGTGATCCCCAAGCTGAGAGACATGAGAGAGCAGATCACCAGCGAGATCCA<br>GAGCAGAGCCGAGAAGAAGTGCCCCGGCAACAAAGAGGTGCAGAGAAATACGCCAAGAGAATACCGGATGAGCG<br>TGCACCGGTGGTCCTATGGCAGACTGATCGAGAGCATCAAGAGCCAGGCCGCCAAGACCGGCATCTTTACCGAGAT<br>TGGCACCCAGCCTATCCGGGGCTCTCCTCAAGAGAAAGCCAGGGACCTGACCGTGTTCGCCTATCAAGAAAGACAG<br>GCCAGCGTGATCTGA |
| TracrRNA<br>(SEQ ID<br>NO: 1247) | TTCACTAATCTGAACCTTGAAAATATAATATTTTTATAACAGCGCCGTAGTTCATGCTCTTTTGAGCCAATGTGCTGC<br>GAAAAATCTGGGTTAGTTTGGCGGTTGGAAGACCGTCAGTGCTTTCTGACCCTGGTAGCTGCCCGCTTCTGATGCTGC<br>CATCTTTAGAATTCTATAGGTGGGATAGGTGCGCTCCCAGCAATAAGGAGTAAGGCTTTTAGCTGTAGCCGTTATTC<br>ATAACGGTGTGGATTACCACAGTGGTGGCTACTAAATCACCCCCTTCGTCGGGGGAACCCTCCCAAATATTTTTTG<br>GCGTGTCAAAGTGGGGCAAAATCCCCGGAGTCCCGCCAAAACTTTAAAACCCTTATCCAGTCTTGAATTAAGAAA<br>CTAGTATGTCAATAAATTTAGTATTTTAATTTTCAGATCGAGACTATTTTAAGCTGACCTGCCAAAGTATGTGTATGG<br>AAAGCTTTGATAGCAAGGGGTTCTAGACGGGTCG |
| DR<br>(SEQ ID<br>NO: 1248) | GTTTCAACAAGCATCCCGGCTAGGGGTGGGTTGAAAG |
| sgRNA<br>(SEQ ID<br>NO: 1249) | TTCACTAATCTGAACCTTGAAAATATAATATTTTTATAACAGCGCCGTAGTTCATGCTCTTTTGAGCCAATGTGCTGC<br>GAAAAATCTGGGTTAGTTTGGCGGTTGGAAGACCGTCAGTGCTTTCTGACCCTGGTAGCTGCCCGCTTCTGATGCTGC<br>CATCTTTAGAATTCTATAGGTGGGATAGGTGCGCTCCCAGCAATAAGGAGTAAGGCTTTTAGCTGTAGCCGTTATTC<br>ATAACGGTGTGGATTACCACAGTGGTGGCTACTAAATCACCCCCTTCGTCGGGGGAACCCTCCCAAATATTTTTTG<br>GCGTGTCAAAGTGGGGCAAAATCCCCGGAGTCCCGCCAAAACTTTAAAACCCTTATCCAGTCTTGAATTAAGAAA<br>CTAGTATGTCAATAAATTTAGTATTTTAATTTTCAGATCGAGACTATTTTAAGCTGACCTGCCAAAGTATGTGTATGG<br>AAAGCTTTGATAGCAAGGGGTTCTAGACGGGTCGGAAATCCCGGCTAGGGGTGGGTTGAAAGNNNNNNNNNNNNNN<br>NNNNNNNNNN |

TABLE 27-continued

| Name/Organism/System ID (T) | | Sequences |
|---|---|---|
| | LE (SEQ ID NO: 1250) | TGAAGCAAAATTAAAGATTGACTTTTCGAGCCTTTGCGCGAAACAAAATTCATTCCCTTAATCAGCAACGCCAATTA<br>AAAAAATCATCTCTAGAAAGAGATTGACAAATAATGTGTCGCCACGGACAAATAATTTGTACATTCGCACGTTATAT<br>GTCGCAATTTGCAAATAACGACATGAGCGTTTTTATCATCTAAAACGCTTATTTTTATAAAGCTTTCAGAACATTTTTC<br>ACTAAAAATATAACATTCCTAAATTCGCATATTGAATGTCGCAAACACTAATGTTCGCAAATTAACGCCGTTGGTCT<br>AAATTTTGTTACCTTGCAAATTCAATGTCGCATTTTCTTAATTCAATGGTACATTGATACTATCAATAACTACATTCT<br>CCTCACTTAAATGCCAGACAAAGAATTTGGATTAACTGGAGAATTGACACAAGTTACGGAAGCTATTTTGCTTGGTG<br>AAAGTAATTTTGTGGTCGATCCATTACACATTATTC |
| | RE (SEQ ID NO: 1251) | AGTTTCAACAAGCATCCCGGCTAAGGGTGGGTTGAAAGGAAATTTTTGTTGTTACTAGGTGAGATATTTGTTTCAAT<br>TAGGAGGGTTGAAAGGCGCACTTCGTTCGGGAATATTCTGAAATTTTTAGCATATTCTACAAGTGTAGTGGGATCAC<br>TCCACCACATCACAGTTGCGACATTAATTTGCGAAAAATCAGTATAATTAAATTGACTCTAAAAATAAGTCAAAGCG<br>ACGCTAATTTGCAAAAAAACGACATTAATTTGCATATTGCGACACATAATCTGCGAATGTACATCGACACATGCACA<br>TCGGGATGACTGGATTCGAACCAGCGGCCCCTTCGTCCCGAACGAAGTGCGCTACCAAGCTGCGCTACATCCCGCTA<br>AAAAAAAAGACAATATTTTATGATTGTACCATAATATCTGAAAAAAGGAAATATAAAAATCAGCTGCTACTGAAC<br>TGTATAGATGACCGAACAAGGCAAAAGTAAAAATTTAAA |
| AAXW01000027.1/<br>Cyanothece sp.<br>CCY0110/<br>T66 | TnsB (SEQ ID NO: 1252) | ATGAAGAACGCCAACTCTCCACCTAGCACCAGCAGCGTGAACAACCCTCTGGAAAAAGAGAACAACGTCATCCCCA<br>GCGAGCTGAGCGACGAGGCCCAACTGAAGCTGGAAGTGATCCAGACACTGCTGAAGCCCTGCGACAGAAAGACCT<br>ACGGCCAGAGACTGCAAGAGGCCGCCGAGAAGCTGGGCAAGAGCAAGAGAACAGTGCAGCGGCTGGTCAAGAAGT<br>GGGAAGAGTTCATCATCAAGAGCTACAAGAACGGCAACAAGGGCAGCAGAAGAGTGACCCGGAAACAGGTGTACC<br>TGCAAGAGTTCATCATCAAGAGCTACAAGAACGGCAACAAGGGCAGCAGAAGAGTGACCCGGAAACAGGTGTACC<br>TGAAGGCCAAGGCCAAAGCCGAGGAACTGGGCATCAATCCTCCAAGCCACATGACCGTGTACCGGATCCTGCAGCC<br>TCTGATCGAGAAGCAAGAAAAGAAGAAGTCCATCAGAAGCCCCGGCTGGCGGGGATCTCAGCTGTCTGTGAAAAC<br>AAGAGCCGGCCAGGACCTGAGCGTGGAATACTCCAATCACGTGTGGCAGTGCGATCACACCCTGGCCGATATCCTG<br>CTGGTGGATCAGTATGGCGAGCTGCTGGGTAGACCTTGGCTGACCACAGTGATCGACACCTACAGCCGGTGCATCA<br>TCGGCATCAACCTGGGCTTCAATGCCCCTAGCAGCCAGATTGTGGCCCTGGCTCTGAGACACGCCATCCTGCCTAAG<br>AGATACACCCCTGACTACCAGCTGTCCGAGGAATGGGCACATACGGCAAGCCCGAGCACTTCTACACCGACAGCG<br>GCAAGGATTTCAGCAGCCACCACATCCAGCAGATCAGCGTGCAGCTGGGCTTCGTGTGCCACTTCAGAGACAGACC<br>TAGCGAAGGCGGCATCGTGGAAAGACCCTTCAAGACCCTGAACCTGGAATTCTTCAGCACCCTGCCTGGCTACACC<br>GGCAGCAATGTGCAAGAAAGACCCGAGGATGCCGAGAAAGAGGCCTGTCTGACACTGCGCAGCTGGAACAGAAA<br>CTCGTGCGGTACATCGTGGACAACTACAACCAGCGGATCGACGCCAGAATGGGCGACCAGACCAGATTCCAGAGAT<br>GGGAGTCTGGCCTGATCGCTAGCCCCGATGTGATCAGCGAGAGAGCTGGACATCTGCCTGATGAAGCAGACCAG<br>ACGGAAGGTGCAGAGAGGCGGCTACCTGCAGTTCGAGAACCTGATGTACCGGGGCGAGAATCTGGCCGGATATGCC<br>GGCAGTCTGTGATCCTGAGATTCGACCCCAGAGATGTGACCACCGTGCTGGCCTACCAGCAAGAGTCCAATCAAG<br>AGGTGTTCCTGACCAGAGCCTACGCCATCGACCTGGAAACCGAGCAGATGAGCCTGGACGAAGCCAAGGCCTCCTC<br>CAAGAGAGTTAGAGAGGCCGGCAAGACCATCAGCAACCGGTCTATCCTGAGCGAGATCAGAGCCGCCGAGGGATC<br>TGCCTATGCCGACAGACAGATCTTCCCTAAGGCCAAGAAGTCTAAGAAAGAGCGCTACCAAGAGGAACAGAAGGC<br>CATCACCAGCAAGCCCCTGGAACAGGTGGAAAGCGAGCTGGAAGAAACCGACGTGCTCAGCAGCAGCTCCGAGAC<br>ATCTCAGGTGGAAGTGTTCGACTACGAAACACTCCAAGAGGACTACGGCTTCTGA |
| | TnsC (SEQ ID NO: 1253) | ATGACCATCCAAGAGGCCCAGGCTGTTGCTCAGCAGCTGGGCGATATCAAGCTGACCAGCGAGAAGCTGCAGGCCG<br>AGATCCAGCGGCTGAACAGAAAGACCGTGGTCACCCTGTCTCACGTGGAAGCCCTGCACAATTGGCTGGAAGGCAA<br>GAGACAGGCCAAGCAGAGCTGTAGAGTCGTGGGCGAGAGCAGAACCGGCAAGAACTGCCTGCAACGCTACCG<br>GCTGCGGCACAAGCCTATTCAGACACCTGGCAAGCCTCCAATCGTCCGTGTGGTGACATCCAAGTGACCCAAGAG<br>TGCGGCGCCAAGGATCTGTTTGGCGCCATCATCGAGCACCTGAAGTACCAGATGACCAAGGGCACCGTGGCCGAGA<br>TTCGGCAGAGAACCTTTAAGGTGCTGCAGAGATGCGGCGTGGAAATGCTGATCATCGACGAGGCCGACCGGCTGAA<br>GCCTAAGACCTTTGCTGAAGTGCGGGACATCTTCGACAAGCTGAATATCGCCGTGGTGCTCGTGGGCACCGATAGA<br>CTGGATGCCGTGATCAAGCGGGACGAACAGGTGTACAACCGGTTCAGAGCTGCCACAGATTTGGCAAACTGGCCG<br>GCGACGAGTTCAGCCAGACAGTGGATATCTGGGAGAGACAGGTGCTGAAGCTGCCCGTGGCCAGCAATCTGAGCAG<br>CAAGCGGATGCTGAAGATCCTCGGACAGGCCACAGGCGGCTATCTGGGACTGCTGGACATGATCCTGAGAGAGAGC<br>GCCATTCGGGCCCTGAAGAAGGGCCTGCAGAAGATCGACCTGGAAACCCTGAAAGAAGTGACCGAGGAATACCGG<br>TGA |
| | TniQ (SEQ ID NO: 1254) | ATGGAAAGCAAAGAAATCCAGCCGTGGTGGTTCCTGGTGCAGCCTCTTGCCGGCGAGAGCATCTCTCACTTTCTGGG<br>CAGATTCCGGCGCGAGAACGAGCTGACCGTGACCATGATGGGCAAGCTGACAGGACTCGGCGGAGCCATTGCCAG<br>ATGGGAGAAGTTCAGATTCATCCCCGCTCCTACCGAGGAAGAACTGACAGCCCTGTCTGAGGTGGTGCAGGTCGAG<br>GTGGAAAGACTGTGGCAGATGTTCCCTCCAAAAGGTGGGCATGAAGCACAGACCCATCAGACTGTGCGCCGCCT<br>GCTACGACGAGGAAAGATGTCACAAGATCGGCTGGCTGGTGGAAGATGACAGCGTGCTGCTGAAGGCCTGGGTCA<br>ACATCGTCGTGGGAATGAGCTGA |
| | Cas12k (SEQ ID NO: 1255) | ATGAGCCAGATCACCATCCAGTGCCGGCTGGTGGCCAAAGAGGCCACAAGACAGACACTGTGGCAGCTGATGGCCG<br>AGCTGAACACCCCTTTCATCAACGAGCTGCTGCAACAGGTGGCCCAGTATCCTGACTTTGAGCAGTGGCGGCAGAG<br>AGGCAGACTGACCGCCAAAGTGATTGAGCAGCTGGGCAATGAGCTGAAGAAGGACCCCAGATTCCTGGGCCAGCCT<br>GCCAGATTCTACACCTCTGGCATCAGCCTGGTCGAGTACATCTTCAAGAGCTGCTGAAGCTGCAGCAGAGACTGC<br>AGAGAAAGCTGGACGGCAAGCGGAGATGGCTGGAAGTGCTGAAGTCTGACGAGCAGCTGATCAAGGACAGCCAGA<br>CCGACCTGGAAACCATCAGACAGAAGGCCACCGAGATCCTGCAGGGCACCAGCCGAGAGACTGTTCAACA<br>GCCTGTTCCAGGCCTACCGGACGAGCAGAACATCCTGACACAGACAGCCCTGAACTACCTGCTGAAGAACCGGTG<br>CCAGCTGCCTAAGAAACCCGAGGACGCCAAGAGTTCGCCAAGCGGCGGAGAAAGGTGGAAATTACCATCAAGCG<br>GCTGCAGAAGCAGATCAACGGCAGACTGCCTCAGGGCAGAGATCTGACCAACGACAACTGGCTGGAAACCCTGAA<br>CCTGGCCTGCGACACCGATCCTAAGGACGTGGAACAGGACAGACCTGGCAGGACAAGCTGCTGAAAAAGGCCA<br>GAGCATCCCCTTCCAATCAACTACGAGACAAACGAGGACCTGACCTGGTCCAAGACGAGAAGGGCAGATTCTGC<br>GTGCAGTTTAACGGCATCAGCGACCTGAAGTTCGAGATTACTGCGACCAGCGGCAGCTGAAGTGGATCAGAGAT<br>TCTACGAGGACCAGCAAGTGAAGAAAACGGCAAGGATCAGCACAGCAGCGGCCTGTTTACACTGCGGAGCGGAA<br>GAATCCTGTGGCAAGAAAGGCAAAGGCAAGGCGAGCTGTGGGACATCCACAGACTGCTCTGCAGTGCACCCTGA<br>AAACACGGTGTTGGACCCACGAAGGCACCGAACAGTGAAACAAGAGAAGGCCGATGAGTCGCCGGCATCCTGA<br>CCAGGATGAATGAGAAGGGCGACCTGACCAAGAACCAGAAAGCCTTCGTCGCGGAAGCAGAGCACCCTGAATA<br>GACTGGAAAGCCCTTTCCACGGCCTAGCCAGCCTCTGTACCAGGGCAAGAGCAATATCCTCGTGGGCGTGTCCAT<br>GGAACTGAAGAAGCTGCCACAATCGCCGTGATCGATGGCGTGACCAGAAAGGTGCTGACCTACCGGAACATCAAA<br>CAGCTGCTGGGCAAGAACTACCCTCTGCTGAACCGACAGCAGCGCCAGAAACAGAGACAGAGCCACCAGCGGAAT |

TABLE 27-continued

| Name/<br>Organism/<br>System<br>ID (T) | | Sequences |
|---|---|---|
| | | ATCGCCCAGCGGAAAGAGGCCTTCAACCAGTTCGGCGATTCTGAGCTGGGACAGCACATCGATAGACTGCTGGCCA<br>AGGCCATCATCTCAATCGCCCAGAAGTACCAGGCCGGCAGCATCGTGGTGCCCAAGCTGGAAGATATCCGCGAGGC<br>CACACAGAGCGAGATCCAGGCCAAAGCCGAGGCCAAGATTCCCAACTGTATTGAGGCCCAGGCCGAGTATGCCAA<br>GAAATACCGGATGCAGGTCCACGAGTGGTCCTACGGCAGGCTGATCGACAACATTCAGGCTCAGGCCAGCAAGCTG<br>GGCATCTTCATCGAGGAAAGCCAGCAGCCTCTGCAGGGCACACCTCTGCAGAAAGCTGCCGAGCTGGCCTTCAAGG<br>CCTACAGATCTAGACTGAGCGCCTGA |
| | TracrRNA<br>(SEQ ID<br>NO: 1256) | AACTTTCATCTGAACCTTGACAATTTAATATGGTATTTTTATACTAAAGAGTATAAATTAGTCGCGCACCGTAAATTA<br>TGTTCTTAATTGAACCTCTAGATTACGGAAAAGGGTTAGTTTGACTGTCGGTAGATAGTTTTGCTTTCTGGCCCTAGT<br>AGCTGTCCACCCTGATGCTGATTTCTACAATTTAGATTGTAGGGATAATAACCTGTAAAAGAGATTAGCTGATAAT<br>TTCATTTTATGGGGAAGGTGCGCTCCCAGCAATAAGTGGCGTGGGTTTACCACAGCGATGGCTACTGAATCACCTCC<br>GACCAAGGAGGAATCCACTTATTTTTCTTACTAATGACGGGATAAGGCATGGTCAAAGATATAGTTAAATTTATAG<br>AGTTTAAGTAGATTGAAAGCGAGTCCAGTTACGTCCTATGAGATTACATCGTTGTGGAGTTTGCTCTCAAGATGTTT<br>GATTGTGCAAGGGCGCAGGTGCGATGCTGTAATTTTTACTAAGTCATTCTAGACTAACGTGAAATCCTTTCTCAATC<br>TTAGTTTGAAGCGTGTAAAAGCAACTATTTTTTGTAGTTGTCTAGCGCAAACCCCGAACCCGTTATTAGATATAGG<br>TTATGGCATTTCTCAGTGTTCATTTTTTAAAGGCCTGTGGCTGAAATGAACTTTTGAGTCTTGTCCAGCGCAGATAG<br>TTAATAAAACCCTTAACACATAAGGTTTTTAGACTCCTGTC |
| | DR<br>(SEQ ID<br>NO: 1257) | CTCGCAATCTATTTTGATTGATGAAATGGATTGAAAG |
| | sgRNA<br>(SEQ ID<br>NO: 1258) | AACTTTCATCTGAACCTTGACAATTTAATATGGTATTTTTATACTAAAGAGTATAAATTAGTCGCGCACCGTAAATTA<br>TGTTCTTAATTGAACCTCTAGATTACGGAAAAGGGTTAGTTTGACTGTCGGTAGATAGTTTTGCTTTCTGGCCCTAGT<br>AGCTGTCCACCCTGATGCTGATTTCTACAATTTAGATTGTAGGGATAATAACCTGTAAAAGAGATTAGCTGATAAT<br>TTCATTTTATGGGGAAGGTGCGCTCCCAGCAATAAGTGGCGTGGGTTTACCACAGCGATGGCTACTGAATCACCTCC<br>GACCAAGGAGGAATCCACTTATTTTTCTTACTAATGACGGGATAAGGCATGGTCAAAGATATAGTTAAATTTATAG<br>AGTTTAAGTAGATTGAAAGCGAGTCCAGTTACGTCCTATGAGATTACATCGTTGTGGAGTTTGCTCTCAAGATGTTT<br>GATTGTGCAAGGGCGCAGGTGCGATGCTGTAATTTTTACTAAGTCATTCTAGACTAACGTGAAATCCTTTCTCAATC<br>TTAGTTTGAAGCGTGTAAAAGCAACTATTTTTTGTAGTTGTCTAGCGCAAACCCCGAACCCGTTATTAGATATAGG<br>TTATGGCATTTCTCAGTGTTCATTTTTTAAAGGCCTGTGGCTGAAATGAACTTTTGAGTCTTGTCCAGCGCAGATAG<br>TTAATAAAACCCTTAACACATAAGGTTTTTAGACTCCTGTCGAAATTGATTGATGAAATGGATTGAAAGNNNNNNNN<br>NNNNNNNNNNNNNNNNN |
| | LE<br>(SEQ ID<br>NO: 1259) | AACTTCATCACGTGCTTTCTTCCATCCAAGCTGAAAACCATCATGATATTTGACTTGAAAAACCCATTCTTTTGGTAC<br>GTCCTCAATTACATTGATAGGTGTACAGTAACTAATTGTTTGTCGTCTTAACAAAATAGTGTCGTCAAAACTTTTAAC<br>CTTCAAACTTTTATATAATCTACGTTATTAGCTGATCATAACATCAATCTTTTATAAAAGTCATTATTCATCTTATTA<br>ACAAATTGACTGTCATTTACCCGAATGGCACTTTTTTTATGACTGAAGCAATATTAACAAATTAATTGTCTCCAAA<br>CTTCAAGGATTGTGATACACTCATATTAAATAAACAATTATGTAATAATCAGACATTGTTGTTCATTATGAAAAATG<br>CAAACTCACCACCCTCTACATCATCAGTTAATAATCCCTTAGAGAAAGAAAATAATGTTATCCCCTCTGAGTTATCT<br>GATGAAGCACAATTAAAGCTTGAGGTTATTCAA |
| | RE<br>(SEQ ID<br>NO: 1260) | CAGCGTCACAATCTATTTTGGTTAATGAGATGGATTGAAAGATTTTTTACCATCGTCTAGGATTAGTCTCGGTAATA<br>GGCACACGACAAATAATATGTTCTTAATGACACCCAATTCGTTAAAGCGACAATAATTTGTTACCGATGACAAATAA<br>TCAGTTACTGTACAAAACTTTAAATTACAAGTTAATATTATACACACTATAAAAAAATATGGACGTAACTGGACTCG<br>AACCAGTGACCCCATCGATGTCAACGATGTACTCTAACCAACTGAGCTATACGTCCGCACAAGTCTTTACTATAACA<br>CAAGATTTACCAAAAACGCAAATAAACAAACAAACTTACATAGATTTCCTTAAGAGATGGGGGAGTCGGGGTCATT<br>GGGGAGTGTAATAAAAGGACAACCCTTGATTATTGATCATTATATGTACGAGAAACTGACACCCCCCACCACTGGTT<br>CTAAAATCACTTTTAAAGACGGTAAACCCATTGTTCCTA |
| JTJD01000271.1/<br>Aphanocapsa<br>montana<br>BDHKU210001/<br>T67 | TnsB<br>(SEQ ID<br>NO: 1261) | ATGGAACTGGTCAACCCCGACGACCTGAACAGCGTGGAAAGCCGGCTGAAGCTGGAAATCATCGAGAAGCTGAGC<br>GAGCCCTGCGACAGAAAGACCTACGGCGAGAGACTGAGAAGCGCCGCTCAGCAGCTGAAGTGTTCTGTCGGACA<br>GTGCAGCGGCTGATGAAGAAGTGGGAAGAAGAAGGCCTGGCCGCTCTGATCGACAGCGGCAGAATCGATAAGGGC<br>AAGCCAGAATCGCCGAGGACTGGCACGAGTTCATCAAGAAGGTGTACAGCAACGACAAGTGCACCCCTGCTCAGG<br>TGTTCACCAAAGTGCGGAACAAGGCCAGACAGCAAGAGGGCCTGAAGGACTACCCCAGCCACATGACCGTGTACCGGAT<br>CCTGAGACTGGTCAAAGAGGCCAAAGAAAGAGGAATCCATCCGGAACCTCGGCTGGAAGGGATCTAGACTGGC<br>CCTGAAAACCAGAGATGGCGAGGTGCTGGAAATTGACTACAGCAATCAAGTGTGGCAGTGCGACCACACCAGAGC<br>CGATATCCTGGTGGATAAGTACGGCCACCAGATGGGCAGACCTTGGCTGACCACAGTGATCGACACTTACAGC<br>AGAGCCATCGTGGGCATCAACCTGGGCTACGATGCCCCTTCAGCAGCGGTTGTGGCTCTGGCTCTGCGGAACGCCAT<br>CATGCCTAAGCAGTACGGCGTCGAGTACAAGCTGTACGCCGATTGGCCTACCTGCGGCACACCTGATCACCTGTTTA<br>CCGACGGCGGCAAGGACTTCAGAAGCAACCACCTGAGACAGATCGGCCTGCAGCTGGGCTTCATCTGTCACCTGAG<br>AGACAGACCTAGCGAAGGCGGAATCGTGGAAAGACCCCTTCGGAACAATCAATACCCAGTTCCTGAGCACCCTGCCT<br>GGCTACACAGGCAGCAACGTGCAGGATAGACCTCTCTGAGGCCGAAGCCGAAGCCGTGTCTGACACTGCAAGAGCTGG<br>AAAAGCTGCTGGTCGCCTACATCGTGAATACCTACAACCAGCGGCTGGACGCCAGAATGGGCGATCAGACCAGAAT<br>TCAGAGATGGGAAGCCGGCCTGCTGAAGCAGCTAGAGTGATCCCTGAGCACGAGCTGCACATCTGCCTGATGCGG<br>CAGACCAGACGGACCATCTACAGAGGCGGCTACCTGCAGTTCGAGAACCTGGCCTATAGAGGCGAAGCCCTGGCTG<br>AACATGCCGGCAACAGATATCGTGCTGAGATACGACCCCCAGAAATATCGCCCAGGTGCTGGTGTACAGACACGACCC<br>CGACAGAGAAGTGTACCTGGGAGTTGCCCAGGCTCTGGAATTCGAGGGCGAAGTGCTGGCCCTGGATGATGCCAAG<br>GCTCACAGCAGACGGATCCGCGAGGATGGAAAGGCCGTGTCCAATGACGCCATGCTGGACGAGATGCGGGATCGC<br>GAAGCCTTCGTGGACCAGAAGAACAAGAGCCGGAAGGACCGGCAGAAGGACGAGCAGGCTGATCTGAGGCCTACC<br>ACACCTCCTATCATCGGCCCTGATAGCAGCGACGAGCCTTCCGTGGATTCGCTCCAGCCTGATGAGAGCCCCGAGGAAC<br>TGGATATCCCCGAGTTCGACATCTGGGACTTCGACGACGATGCCTGA |
| | TnsC<br>(SEQ ID<br>NO: 1262) | ATGATCGCCCTGCAGGACCAAGAAGTGCAGGCCCACATTGAGCGGCTGCGGAGAGATAAGACAGTGGCCCTGGAT<br>AGCGTGAAGCAGGCCCATACCTGGCTGAAGCGGAAGAGAAACGCCAGACAGTGCGGCAGACTGACCGGCGATTCT<br>AGAACCGGCAAGACCAAGACCTGCGAGGCTTCCTGAAGCTGCAGCCTGATCTGAGCGGCAGAGTGCCTA<br>TCATCCCCATCAGCTACGTGCACCCCAAGCAAGAGTGCACCAGCAGAGAGCTGTTCAGAGAGATCCTGGAACAGTA<br>CGGCGACGACCTGCCTAGAGGCACAGTGGGAGATGCCAGATCTCGGACCCTGAAGGTGCTGAGAGCCTGCAAGACC<br>GAGATGCTGATGATCGACGAGGCCGACAGACTGAAGCCCAAGACCTTTGCCGACGTGCGGGACATCTTCGACAAGC<br>TGGAAATCAGCGTGATCCTGATCGGCACCAAGCAGCGGCTGGATCCCGCCGTGAAGAAGACGAACAGGTGTTCAA<br>CCGGGTTCAGAAGCAGCTACCGGATCGGCACAATCCCCAGCAACCAGCTGAAAACCATCGTCGGCCTGTGGGAGAGA |

TABLE 27-continued

| Name/<br>Organism/<br>System<br>ID (T) | | Sequences |
|---|---|---|
| | | GACATTCTGAAGCTGCCCGTGCCTAGCAACCTGACCTCTGAGGCCATGCTGAAAGAGCTGAGAAAGGCCACCGGCG<br>TGTCCCGGAAGGGCTATTATATCGGCCTGATCGACATGGTGCTGCGCGAGGCTGCTATCAGAGCCCTGGAAAAGGG<br>CCAGAGCAAGATCGAGCTGGAAACCCTGAAAGAGGTGGCCAAAGAGTACAGCTGA |
| | TniQ<br>(SEQ ID<br>NO: 1263) | ATGGTCATCCCTCAGATCCCTGCCTGGGTGTTCCCCGTGGAACCTTCTCCTGGCGAATCCTGTCTCACTTCCTGGG<br>CAGATTCTGCAGAGAGAACCACACCACACTGAACCAGCTGGGCGAGAAAACAGGACTGGGAGCCGTGCTCGGAAGA<br>TGGGAGAAGTTCCGGTTCATCCCACAGCCTAGCGACGCTCAACTGGCCGCTCTGGCCAAACTCGTCAGACTGGAAG<br>TGGACCAGATCAAGCAGATGCTGCCCAAGAGACAATGCAGAACAGAGTGATCAGACTGTGCGCCGCCTGCTACGC<br>CGAGGAACCTTATCACAGAATCGAGTGGCAGTACAAGCTGGCCAACAGATGCGACCGGCACCATCTGTTGCTGCTG<br>CTGGAATGCCCCAACTGCAAGGCCAAGCTGCCCATGCCTAGCAAGTGGGCCAATGGCACATGCAAGCGGTGTCTGA<br>CCCCCTTTCGAGCAGATGGCCGATCTCCAGAAGGGCATCTGA |
| | Cas12k<br>(SEQ ID<br>NO: 1264) | ATGGTGCAGATGAACTACATCTGCGCCCTGAGCATCAAGTTCGTGATGAGCAAGATCACCATCCAGTGCCGGCTGG<br>TGGCCAGCGAAGCCACAAGACAGTATCTGTGGCACCTGATGGCCGACATCTACACCCCTTTCGTGAACGAGATCCT<br>GCGGCAGATCAGAGAGGACGACAACTTCGAACGATGGCGGCAGAGCGGAAAGATCCCTGCCTCCGTGTTCGAGGA<br>CTACAGAAAGACCCTGAAACCGAGAGCCGGTTCCAGGGCATGCTGGCAGATGGTATTACGCCGGCAGAGAAGA<br>AGTGAAGCGGATCTACAAGAGCTGGCTGGCCCTGCGGAGAAGGCTGAGAAATCAACTGGCCGGACAGAACCGGTG<br>GCTGGAAGTGCTCAGTCCGACGGACACTGATGGAAGTGTCCGGATCTGAGCGCTCTGCAGGCTGAAGCT<br>AGCCAGCTGCTGAATATCCTGGGCAGCAAGAACAAGCCAGCAAGAATCGGAGCAAGAAGGCCAAGGGCAAGCCT<br>AAGGGCAAGAGCGCCAAGGATCCCACACTGTATCAGGCCCTGTGGGAGCTGTACAGAGAGACAGAGGATATCGCC<br>AAGAAATGCGTGATCGCCTACCTGCTGAAGCACAAGTGCCAGGTGCCAGACAAGCCCGAGGATCCCAAGAAGTTCA<br>GACACAGGCGGAGAGAGGCCGAGATCAGAGCCGAGAGACTGAACGAGCAGCTGATCAAGACCAGACTGCCCAAGG<br>GCAGAGATCTGACCAACGAGCAGTGGCTGCAGGTCCTGGAAATCGCCACTAGACAGGTGCCCAAGGACGAGGATG<br>AAGCCGCCATCTGGCAAAGCAGACTGCTGACCGATGCCGCCAAGTTTCCATTTCCTGTGGCCTACGAGACAAACGA<br>GGACCTGAAGTGGTTCCTGAACGGCAAAGGCAGGCTGTGCGTGTCCTTCAATGGCCTGAGCGAGCACACCTTCGAG<br>GTGTACTGTGGCCAGAGACAGCTGTACTGGTTCAACCGGTTCCTCGGAAGATCAGCAGATCAAGAAGAGAACCAGG<br>GCGAGAGAAGCGCCGGACTGTTCACACTGAGAAGCGGCAGACTCGTGTGGAAGCCCTACAGCTCTGACGCCAGCAG<br>ATCCGATCCTTGGATGGCCAATCAGCTGACCCTGCAGTGTAGCGTGGACACCAGACTGTGGACAGCCGAGGGAACA<br>GAGCAAGTGCGGCAAGAGAAGGCCACCTCTATCGCCAAAGTGATCGCCGGCACAAAGGCCAAAGGGAACCTGAAC<br>CAGAGCAGCAGGACTTCATCACCAAGCGGGAACAGCACTCGAGCTGCTGCACAACCCATTTCCACGGCCTAGCA<br>AGCCTCTGTACCAGGGAAAGCCCAGCATCATTGCCGCCGTGTCTTTCGGCCTGGAAAAGCCTGCCACACTGGCCATC<br>GTGGACATCGTGACCGATAAGGCCATCACCTACCGGTCCATCAGACAGCTGCTGGGCCAGAACTACAAGCTGTTCA<br>CCAAGCACCGGCTGAAACAGCAGCAGTGCGCCCACCAGAGACACCAGAATCAGGTGGAAAGCGCCGAGAACCGGA<br>TCTCTGAAGGCGGACTGGGAGAGCACCTGGATAGCCTGATTGCCCAAGGCCATCCTGGAAACAGCCGCCGAGTATGG<br>CGCCAGCTCTATTGTGCCTGCCTGAGCTGGGCAACATCAGAGAGATCATCCACGCCGAGATTCAGGCCAAGGCCAG<br>AGAAAGATTCCCGGCCTGAAAGAAAAGCAGGACGAGTACGCCGCCAAATTCGAGCCTCCGTGCACAGATGGTCCT<br>ACGGCAGACTGGCCCAGAAAGTGACCACCAAAGCCAGCCTGCACGGACTGGAAACCGAGTCTACAAGACAGAGCC<br>TGCAGGGCACCCCTCAAGAGAAAGCCAGAAACCTGGCCATCAGCGCCTACGAGTCTAGAAAGGTGGCCCAGAGAG<br>CCTGA |
| | TracrRNA<br>(SEQ ID<br>NO: 1265) | CAAGTTCGCACGTACTACTAAAATATACCTAGCGCCTAAGCTCATGCCGTCAGTGGCCTCTGTGCTCAGAAAAAAGG<br>CTAGTTTGACGGTCTGAACACCGTCCTGCTTTCTGGCCCAGATGACTATCCATCCCCGAAGTTGTGAGCGCACGCAG<br>CAAGAGGGCACGGGTTCTGGAGTGATGGTTATCAAGTTCACCTCCGAGCAAGGAGGAATCCACCCAAAACTTAAAA<br>TTGGCAAACCTAAGCGAGGTCAAGATCCCTAGGAGGTTTGCCAAAGTTCTAAAGCTCTTTATCCACACAAGTTTGAA<br>CGAGTTGTTTCGTTCAAATTGCTAGCTCCCTAGAATTTTTCTGTAGAGTTAGATTGAGCTTTGCCAAATTTAGCCTGA<br>AAAGCTTGTGGGTATGCCTTTCCGATGGCAAG |
| | DR<br>(SEQ ID<br>NO: 1266) | GTCGCCAAAAGCATTTCAGGGCAGGGCGGGTTGAAAG |
| | sgRNA<br>(SEQ ID<br>NO: 1267) | CAAGTTCGCACGTACTACTAAAATATACCTAGCGCCTAAGCTCATGCCGTCAGTGGCCTCTGTGCTCAGAAAAAAGG<br>CTAGTTTGACGGTCTGAACACCGTCCTGCTTTCTGGCCCAGATGACTATCCATCCCCGAAGTTGTGAGCGCACGCAG<br>CAAGAGGGCACGGGTTCTGGAGTGATGGTTATCAAGTTCACCTCCGAGCAAGGAGGAATCCACCCAAAACTTAAAA<br>TTGGCAAACCTAAGCGAGGTCAAGATCCCTAGGAGGTTTGCCAAAGTTCTAAAGCTCTTTATCCACACAAGTTTGAA<br>CGAGTTGTTTCGTTCAAATTGCTAGCTCCCTAGAATTTTTCTGTAGAGTTAGATTGAGCTTTGCCAAATTTAGCCTGA<br>AAAGCTTGTGGGTATGCCTTTCCGATGGCAAGGAAATTTCAGGGCAGGGCGGGTTGAAAGNNNNNNNNNNNNNNN<br>NNNNNNNNNN |
| | LE<br>(SEQ ID<br>NO: 1268) | TATTGGGAAAATTGGTTCACCGAGATTTAGGCCAAATGGAGGTTGAAAACCACCATTACATAGATAAGTGGCCAAT<br>TTAATTCGCGAACGTACATGTCGCATAACACGTAATCCGTCGCCATAACACGCTCTTGTCGCCGACCATTAAATGGC<br>TAGACCCCTTTGAATTCAGGAACCTTGGCGATTTCATCCTCACTCTAAAGAGCGCTCTTGAATAACAAAATATTTGA<br>CGCCTCTTTGAAGAATGAACACAATCAGTGTCGTCTTTGAAGCTGAAATCGCCTCAGTTAACGCACTCTTTGTC<br>GCCTCTTTTGCGGCTTTGTCGGATCTGATCTAACAAATTAGATGACATATCTTGGACTATAGTACATTTGATTTAAT<br>TCACTTGTACTAGGTGACTCCATGGAACTTGTTAATCCAGATGATCTGAATTCAGTAGAATCCAGGCTCAAGCTAGA<br>AATTATCGAGAAACTTTCAGAGCCCTGCGATCGCAAAA |
| | RE<br>(SEQ ID<br>NO: 1269) | GGTCGCCAAAAGCATTTCAGGGCAGGGCAGATTGAAATCGCTAGGGCCTGCCTGATTACGACCAACTTGTTTCATCA<br>GAGCGATACAGATGAAATCTTTAGAATATTTGTAATCATATCGGCGTTAACATATCAAGCAGGTGGATTTGAA<br>AGGCGCACTTCGTTCGGGAAAGGGCAGCTTAGTCTTGATAAGTGCTTTTTTAGATCAAACTCGATCGACGACAATA<br>TTGTGTGATCAGTCGCATCTAGCAACTAAACGACACGAATGTGATGGACAGCGAAATAGTTACGATGACAC<br>GAATGTGTTATCGATGACAAATAATATGTTACTCGACAACTTTGAAAGAATCGGGATGAGAGGATTCGAACCTCCG<br>GCCCCCTTCGTCCCGAACGAAGTGCGCTACCAAGCTGCGCTACATCCCGTAGTTATCAGATACTAAATTAGCATAGAG<br>GCGCGATCGCTGTTCATTGCCTTTGAAAATTGAAAACCGTT |
| KK073769.1/<br>Scytonema<br>hofmanni<br>UTEX 2349/<br>T68 | TnsB<br>(SEQ ID<br>NO: 1270) | ATGGCCGACGAGGAATTCGAGTTCACCGAGGAACTGACCCAGGTGCCAGATGCCATCCTGCTGGACAAGAGCAACT<br>TCGTGGTGGACCCCAGCCAGATCATCCTGGAAACCAGCGACAGACAGAGGCTGACCTCAACCTGACCAGTGGCT<br>GGCCGAGTCTCCCAACAGAACCATCAAGCAGCCAGCGGAAGCAGGCCATTGCCGATACACTGGGCGTGTCCACCGA<br>CAGGTGGAAAGACTGCTGAAGCAGTACGACGAGGACCGGCTGACAGAGACAGCCGGAATTGAGAGCGACAAG<br>GGCAAGTACCGGGTGTCCGAGTACTGGCAGGACTTCATCAAGACCATCTACCAGAAGTCCCTGAAGGACAAGCACC<br>CTATCAGCCCTGCCTCTGTCGTGCGGGAAGTGAAGAGACACGCCATCGTGGACCTGAAGCTGAAGCCTGGCGACTT<br>CCCTCACCAAGCCACCGTGTACAGAATCCTGACACCTCTGATCGAGCAGCACAAGAGAAAGACCAGAGTGCGGAAT |

TABLE 27-continued

| Name/<br>Organism/<br>System<br>ID (T) | Sequences |
|---|---|
| | CCTGGCAGCGGCAGCTGGATGACAGTGGTCACAAGAGATGGCCAGCTGCTGAAGGCCGACTTCAGCAACCAGATCA<br>TTCAGTGCGACCACACCAAGCTGGACATCCGGATCGTGGACATCCACGGCAGCCTGCTGTCTGATTGTCCTTGGCTG<br>ACCACCATTGTGGACACCTACAGCAGCTGCGTCGTGGGCTTCAGACTGTGGATCAAGCAGCCTGGCAGCACCGAAG<br>TTGCCCTGGCTCTGAGACATGCCATTCTGCCCAAGAACTACCCCGACGACTACAAGCTGAACAAAGTGTGGGAGAT<br>CAGCGGCCCTCCATTCCAGTACTTTTTCACCGACGGCGGCAAGGACTTCAGAAGCAAGCACCTGAAGGCCATCGGC<br>AAGAAACTGGGCTTCCAGTGCGAGCTGAGAGACAGACCTCCTGAAGGCGGCATCGTGGAACGGATCTTTAAGACCA<br>TCAACACCCAGGTCCTGAAGGATCTGCCTGGCTACACAGGCGCCAACGTGCAAGAAAGACCCGAGAACGCCGAGA<br>AAGAGGCCTGCCTGACAATCCAGGATCTGGATAGGATCCTGGCCAGCTTCTTCTGCGACATCTACAACCACGAGCC<br>GTATCCTAAAGAGCCCCGGGACACCAGATTCGAGCGGTGGTTTAAAGGCATGGGCGGCAAGCTGCCTGAGGCTCTG<br>GATGAGAGAGAGCTGGATATCTGCCTGATGAAGGAAGCTCAGAGAGTCATTCAGGCCCACGGCTCCATCCAGTTCG<br>AGAACCTGATCTACAGAGGCGAGTCTCTGAAGGCCTACCGGGGCGAGTATGTGACCCTGAGATACGACCCCGACCA<br>CATTCTGACCCTGTACGTGTACAGCTGCGAAACCGACGACAACGTGGAAAACTTCCTGGACTACGACCCACGCCGTG<br>AACATGGACACACACGATCTGAGCGTGAAGAACTGAAGGCCCTGAACAAGGATCGGACAAGGCCCGGAAAGAG<br>CACTTCAACTACGACGCCCTGCTGGCCCTGGGCAAGAGAAAAGAACTGGTGGAAGAGAGGAAAGAGGACAAGAA<br>GAGAAGCGGCGGAGCGAGCAGAAGAGACTGAGAGGCGCCAGCAAGAAAAGCAGCAACGTGATCGAGCTGCGGAA<br>GTCCAGAGCCAGCACCAGCCTGAAGAAGGACGACCACCAAGAGGTGCTGCCCGAGAAAGTGTGCACCGAAGAGAT<br>CAAGATCGAGAAGATTGAGCCCCAGCCTCAAGGAACATCAGCGCCCAGATCGACACCCAAGAGGAACACAGGCA<br>CAAGCTGGTGGTGTCCAACCGGCAGAAGAACCTGAAGAAAATCTGGTGA |
| TnsC<br>(SEQ ID<br>NO: 1271) | ATGGCCAGATCTCAGCTGGCCACACAGAGCTTCGTGGAAGTGCTGGCTCCTCAGCTGGATCTGAAGGCCCAGATCG<br>CCAAGACCATCGACATCGAGGAACTGTTCCGGACCTGCTTCATCACCACCGACAGAGCCAGCGAGTGCTTCAAGTG<br>GCTGGACGAGCTGCGGATCATGAAGCAGTGCGGCAGAGTGATCGGCCCCAGAGATGTGGGCAAAAGCAGAGCTGC<br>CCTGCACTACCGCGACGAGGACAAGAAAAGGGTGTCCTACGTGAAGGCCTTGGAGCGCCAGCAGCTTCAAGAGACTG<br>TTCAGCCAGATCCTGAAGGACATCAACCACGCCGCTCCTACCGGCAAGAGACAGGATCTGAGGCCTAGACTCGGCG<br>GCAGCCTGGAACTGTTTGGACTGGAACTGGTCATCATCGACAACGCCAGAACCTGCAGAAAGAGGCCCTGATCGA<br>CCTGAAGCAGCTGTTCGAGGAATGCCACGTGCCAATCGTGCTCGTCGGCGGAAAAGAGCTGGACGATATCCTGCAG<br>GGCTGCGACCTGCTGACCAACTTTCCCACACTGTACGAGTTCGAGCGGCTGGAACAAGAGGACTTCAGAAAGACCC<br>TGAGCACCATCGAGTTCGACATCCTGAGCCTGCCTGAGGCCTCTAATCTCGGCGAGGGCAACATCTTCGAGATCCTG<br>GCCGTGTCCACCAACGCCAGAATGGGCGTGCTGGTCAAGATCCTGACAAAGGCCGTGCTGCACAGCCTGAAGAACG<br>GCTTCAGCAGAGTGGACGAGAGCATCCTGGAAAAGATCGCCAGCAGATACGGCCGGAAATACGTGCCCCTGGAAA<br>GCCGGAACCGGAACGAATGA |
| TniQ<br>(SEQ ID<br>NO: 1272) | ATGCTGGTGGTCATGGCCGAGAACACATTCCCCAGCAAGGTGGAAATCGGCATGAACGAGGACGACGAGATCCTGC<br>CTAAGCTGGGCTACGTGGAACCTTACGAGGGCGAGAGCATCAGCCACTACCTGGGCGACTGCGGAGATTCAAGGC<br>CAACAGCCTGCCTAGCGGCTACAGCCTGGGAAAGATTGCTGGACTGGGCGCCGTGATCAGCAGATGGGAAGACTG<br>TACTTCAACCCGTTTCCTACACAGCAAGAGCTGGAAGCCCTGGCCTCTGTTGTGGAGTGAACGCCGATAGACTGAG<br>CCAGATGCTGCCTCCTAAGGGCGTGACCATGAAGCCCAGACCTATCAGACTGTGCGGCGCCTGCTACCAAGAGAGC<br>CCCTTTCACAGAATCGAGTGGCAGTTCAAGGACGTGATGGTCTGCGACCGGCACCAGCTGAGACTGCTGACCAAGT<br>GCACCAACTGCGAGACACCCTTTCCTATACCTGGCGACTGGGTGCTGGGAGAGTGCCCTCACTGCTTTCTGCCTTTT<br>GCCACCATGGCCAAGAAGCAGAAGAAGGGCTGA |
| Cas12k<br>(SEQ ID<br>NO: 1273) | ATGAACGGCTACATCTACAGCAACGACGACGACATCAAGAAAAAGTGATCCTCGTGTGGCAGATCTACTTCCTGA<br>AGCAGCTGATCGAGAGCGGCACCTACAGCTTCATCAAGTACCTGTACTTCCCCAACGAGTGCCTGCTGAAGATCAA<br>GAACATCATTCTTGTCTGGCAAATCTATTTTCTCAAACAGCTCATCGAGTCCGGCAGCTACTCTTTTTATCAAGTATCT<br>CTACTTTCCGAATGAGTGTCTCCCCAAGATTAAGAATATCATACTCGTTTGGCAGATTGGCTTTCTGAAGCAACTCAT<br>TGAGTCTGGCCTGTACTCCTTTATTAAGTACCTTTATTTCCAGCGCGGCTGGCTGCCCAAGAGGGATGTGAATTGGCT<br>GAACCTGAAGAACAAGCCCGGCAGGATCTTCGTGAAGTTCAACGGCCTGAAGAAGAACATTATCAACCCCGAGTTC<br>TACATCTGCTGCGGCAGCCGGCAGCGGAACTACTTCCAGAGATTCTGCCAGGACTGGCAAGTGTGGCACGACAACG<br>AGGAAACCTACAGCAGCGGCCTGTTCTTCCTGAGAAGCGCCAGACTGCTGTGGCAAGAGCGGAAAGGCATTGGCGC<br>CCCTTGGAAAGTGAACCGGCTGATCCTGCAGTGCAGCATCGAGACAAGACTGTGGACCGAGGAAGAGACAGAACT<br>CGTCCGGACCGAGAAGATCGTGAAAACCGAGAAAACCATCCGGAAGATGGAACAAGAGCGGGATCTGACCCAGAA<br>ACAGCTGACCCATCTGCAGAGAGAGCGGACCCAGAGGCAGAAGCTGAACAACCCATTTCCAGGCAGACCCAGCCA<br>GCCTCTGTACCAGGGCAAGAGCAATATCATCGTGGGCGTGTCCTTCGGCCTGGACAAACCTGCTACAGTGGCCGTG<br>GTGGATGCCGCCAACAACAAGGTGCTGGCCTACAGAAGCACCAAACAGCTGCTGGGAAAGAACTACAACCTGCTG<br>AACCGGCAGCAGCAGCAGAGACTGAGCCACGAGCAGCACAAGGCCCAGAAGCAGTTCGCCCTGAACGAT<br>TTCGGCGAGTCTGAGCTGGGCCAGTACGTGGACAGACTGCTCGCAAAGAGATCATTGCCATTGCCAAGACCTACA<br>AGGCCGGCAGCATCGTGATCCCCAAGCTGAGAGACATGAGAGAGCAGATCAGCAGCGAGATCCAGAGCAGAGCCG<br>AGAAGAAGTGCCCCGGCTACAAAGAGGCCCAGCAGAAGTACGCCAAAGAATACCGGATGAGCATCCACAGATGGT<br>CCTACGGCCGGCTGATTGAGAGCATCAAAAGCCAGGCCGCCAAGGCCGGAATCAGCACAGAGATTGGCACCCACC<br>AGATCAGAGGCAGCCCTGAGGAAAAGGCCAGAGATCTGGCCGTGTTCGCCTACCAAGAAAGACGGGCCGCTCTGGT<br>GTAA |
| TracrRNA<br>(SEQ ID<br>NO: 1274) | TTCACTAATCTGAACCTTGAAAATATAATATGGATATAACAGCGCCGCAGTTCATGCTCTTTGGAGCGCTGTACTG<br>TGAAAAATCTGGGTTAGTTTTTGGCGGTTGTCAGACCGTCATGCTTTCTGACCCTGGTAGCTGCCCGCTTCTGATGCT<br>GCTGTCGCAAGACAGGATAGGTGCGCTCCCAGCAATAAGGAGTAAGGCTTTTAGCCATAGTCGTTATTTATAACGGT<br>GTGGATTACCACAGTGGTGGCTACTGAATCACCCCCTTCGTCGGTCGGGGGAACCCTCTCAAATATTTTTTGGCGT<br>GTCAAAGCGGGGGCAAAATCCCTGGAGTCCCGCCAAAACTTTAAAACCCTTATCCAGTCTTGACTTAAGAAACTAG<br>TATGTCAATGCATTTAGTTTTTTAATTTTCAGTTCGAGACTTTTTAAGCAGACCTGCCAAATTATGTGTATGGAAAGC<br>TTTTATAGCAAGGGTTCTAGACGGGTCGA |
| DR<br>(SEQ ID<br>NO: 1275) | GTTTCAACAACCATCCCGGCTAGGGGTGGGTTGAAAG |
| sgRNA<br>(SEQ ID<br>NO: 1276) | TTCACTAATCTGAACCTTGAAAATATAATATGGATATAACAGCGCCGCAGTTCATGCTCTTTGGAGCGCTGTACTG<br>TGAAAAATCTGGGTTAGTTTTTGGCGGTTGTCAGACCGTCATGCTTTCTGACCCTGGTAGCTGCCCGCTTCTGATGCT<br>GCTGTCGCAAGACAGGATAGGTGCGCTCCCAGCAATAAGGAGTAAGGCTTTTAGCCATAGTCGTTATTTATAACGGT<br>GTGGATTACCACAGTGGTGGCTACTGAATCACCCCCTTCGTCGGTCGGGGGAACCCTCTCAAATATTTTTTGGCGT<br>GTCAAAGCGGGGGCAAAATCCCTGGAGTCCCGCCAAAACTTTAAAACCCTTATCCAGTCTTGACTTAAGAAACTAG |

TABLE 27-continued

| Name/Organism/System ID (T) | | Sequences |
|---|---|---|
| | | TATGTCAATGCATTTAGTTTTTTAATTTTCAGTTCGAGACTTTTTAAGCAGACCTGCCAAATTATGTGTATGGAAAGC<br>TTTTATAGCAAGGGTTCTAGACGGGTCGAGAAATCCCGGCTAGGGGTGGGTTGAAAGNNNNNNNNNNNNNNNNNNN<br>NNNNNN |
| | LE<br>(SEQ ID<br>NO: 1277) | TTTAATGAAAGTCACGAAAATACGTAACTTATGTCCCACGAATTCGGAAAATTGGACATTAATTCTTTAAAACTGAC<br>AATAATTATTTAAATTATGTACATTCGCAAATTATATGTCGCGATTCGCAAATTAGTGTCGCAACTGCTTTAAAGCCT<br>GGAAGCTATATTGTGTAAGTATCATAAGCTATTTACCCCAGAAAAGACCAATAAACTTAATTCGCATATTGTATGTC<br>GCAAAGTCCAATTTCGCATATTATATGTCGTTTGTTAAGAATTAGGTCTTTCGCAAATTAGATGTCGGATTTTGTCAT<br>AATTAATGGTACATTAGTACGTTAATTATTCATGAGTGGGTTTCACTCTAATGGCAGACGAAGAATTTGAATTCACT<br>GAAGAATTGACACAAGTTCCAGACGCTATTTTGCTTGACAAGAGTAATTTTGTGGTAGACCCATCGCAAATTATTCT<br>AGAAACTTCGGATAGGCAAAAACTGACATTTAATCT |
| | RE<br>(SEQ ID<br>NO: 1278) | GCTAGGAGTGTATTAATAATAGAAGATTCAAATCTTTCAAATTTTTCTGAGAGGGTTGAAAGGAGCGCTACAATGGC<br>ATCATTGATTTCAGAACTTTAGAATAATTGAACTACGAGCTTAAATAATAATGCTTTCTTTTCGACGACATTATTT<br>TGTTAACGTTTACTATGTTTGTTTAGACGACACTAATTTGTTAATAACGACATTAATCTGTTATTCGACATCTAGCTA<br>TTAGGGCGACAAATAATTTTGTCGCTCTATGACTTGAGATCAAGACAGTCTGCGACATTAATTTGCGAAAAGTTAGTG<br>TAATTAAATTACCTACATAAAAACCACCAAAGCGACATTAATGTGCCAATCGCGACACTAATTTGCGAATTGCGAC<br>ATATAATTTGCGAATTTACAACAATGGAGGTAAGCGGGTTCGAACCGCTGACCTCTGCAATGCCATTGCAGCGCTCT<br>ACCAACTGAGCTATACCCCCTTGTCATGCGTTTCTGA |
| KV757663.1/<br>Nostoc<br>sp. KVJ20/<br>T69 | TnsB<br>(SEQ ID<br>NO: 1279) | ATGAGCACCAGAAGCCTGTCTCAGGGCGCCAATCTGCCTGGACACGAAGAAGTGCTGGCCACAGAGCAAGGCGGC<br>GAACAGGTGGAAGGCAAGACTACCTGCTGTTCAACGACGACAGCCCCGAGTTCAGCAGAAAGTGGACGTGATC<br>GACGCCATCGTGCAGGCCCCTGACAAGAACGCCAGAAGAGGCCATTGCCGAGGCCGCTAAAGCCCTGGGCAAG<br>TCCACCAGAACCATCAAGCGGATGATCGAGCGGGTGCAGAAAGACGGCGTTGCCACACTTGCTGTGGGCAGACAGG<br>ATAAGGGCCAGTTCAGAATCAGCGAGCAGTGGTTCAAGTTCATCGTGGACACCCACAAATGGGGCCAGACCAAGGG<br>CAGCAGAATCAACCACAACCAGATCCACGTGCAGCTGATCTCCCTGGCCAGCAAGGGCAGATCTGCGGAGCAAG<br>AAATACGTCGAGAAGTTCAAGCAGTACCCCGAGGTGCTGGAAGATCTGATCGAGGGCAAGTTCCCAGCCACGTGA<br>CCGTGTACAAAGTGATCAACTTCTACATCGAGCAAGGAAGAACCGGATCGTGCGGCACCCTGGATCTCCAAGAGAGGG<br>CCAGATCATCCAGACCACCGAGGGCATCCTGGAAATCAGCCACAGCAATCAGATCTGGCAGGTCGACCACACCAAG<br>CTGGACATCCTGCTGATCGACGATGAGGACAAAGAGATCATCGGACAGACCCTCACATCACCCTGGTCATGGACAGAT<br>ACAGCGGCTGCGTCGTGGGCTTTTACCTGGGCTATGAGTCTGCCGGCTCTCACGAAGTGGCCCTGGCCTTCAGACAC<br>AGCATCCTGCCTAAGCACTACGAGCCCGAGTACGAGCTGCAAGAGAAGTGGGACATCTTCGGCGTGCCAGAGTACC<br>TGGTCACCGACAGAGCCAAAGAGTTCAAGAGCGCCCACCTGAAGCAGATCAGCCTGCAGCTGGGCTTCCAGCGGAG<br>ACTGAGAGCCTTTCCTTCTGCCGGCGGACTGATCGAAACCATCTTCGACAAGATCAACAAAGAGGTGCTGAGCTTCT<br>TCGGCGGCTACACAGGCAGCTCTGTGGAAGAAAGACCCAAGAATGCCGAGAAAACCGCCTGTCTGACCCTGGACCA<br>GCTGGAAAAGATCCTCGTGCGGTACTTCGTGGACCACTACAACCAGCACGACTACCCCAAAGTGAAGCAGCTGAAG<br>CGGATCGAGAGATGAAGTCCATGCTGGTGGAACCCGAGGTGTTCGACGAGAGAGCTGGATATCTGCCTGA<br>TGAAGGCCACCTACCGGAACGTTGAGAAGTACGGCAGCGTGAACTTTGGCGGCCTGGTGTACCAGGGCGATAGCCT<br>CGTTGGATACGAGGGACAGAAGATCTCTCTGAGATACGACGACGCGAACATCCTGACACTGCTGGCCTACACCAGA<br>CCTAGCAATGCCCAGCCTGGCGAGTTTATCGGCGTGGTCAAAGCCCGCGACCTGGAAAAAGAGAGACTGAGCCTGG<br>GCGAGCTGAACTGGATCAAGAAGAAGCTGCGCGAGAAGGCCAAAGAAGTGGACAACAGCTCCATCCTGAACGAGC<br>GGCTGAAGATCGTGGAAGAGGTCGAGGAAGGCAGAAAGAGCCGGCGGAAGAGACAGAGGAAGGCCCAAGAAAAG<br>CACGCCCACGAGACGCAACAAGACAAAGTGCTGGAAATGTTCCCCGAGACGCCACACTGGAAGAAACCGCCATC<br>ACACAAGAGAACTTCCCCAGCGCTCCTACCACCAGCAGAACGGTCAAGACATCAACAAGCAGGATATCCCCG<br>AGGCCAACCGGACCGCCAAAACAAGACGACCTAGAGTGGGAGTGCAGGACTGGAACCAGTTCGTGAAGGACAACT<br>GGTGA |
| | TnsC<br>(SEQ ID<br>NO: 1280) | ATGAGCGAGACAAATCTGGCCCACGTGCAGCCCCAAGCTGCAGAAGCAGTTTGACGCCTCTCTGCAGTCCGCCGAGG<br>AACTGAGAAGGCTGCCAGAGATTCAGGCCGAGGTGGAAAGAATCGGCAAGGCCGATACCTACCTGCCTCTGGACA<br>GAGACACCGAGCTGTTCGACTGGCTGGACGATCAGAGGGATGCCAAGCTGTGTGGCTACGTGACAAGCGCCACAGG<br>CTCTGGACTGCTGAAAGCCTGCCAGCTGTACCGGATGCAGTACGTGAAGAGAAGAGGCCACCCTGCTGGAAATCCCC<br>GCCCACAGTGATCTACGCCGAGATCGATCAACACGGCGGACCCACCGATCTGTACTACAGCATCCTGGAAGAAGTGG<br>GACACCCTCTGACCAATGTGGGCGCCCTGAGAGATCTGAGAGCCAGAGCTTGGGGAACCCTGAAGGCCTACGGCGT<br>GAAGATCCTGATCGTGGGCAACGCCGACTACCTGACACTGGAAGGCTTCAACGAGCTGGTGGACATCTTCACCAAG<br>CGGCGGATCCCCATCATCCTCGTGGGCACCTACTACCTGAGCGAGAATATCCTGGAACGGAAGTCCCTGCCTTACGT<br>GCGGGTGCACGACAGCTTTCTGGAACCCTACGAGTTCCCCAACCTGACCGAAGAGGACATCATCGAGGTGGTGGAC<br>GACTGGGAGCAGAAGTTCCTGACACAGGACGGCCGGCTGAATCTGACCCAGATGGAAAGCGTGATCAGCTACCTGA<br>AGCTGAAGTCTGGCCGGCTGATCGAGCCCCTGTACGACCTGCTGAGAAAGATCGCCATTCTGAAGCTGGACGAGCC<br>CAGCTTCGAGCTGAGCCAGGACAATCTGACCAGAAAGTTCGGCAGACGGAAAGAGCCCAAAGTCAAGTTCCAGCG<br>GAAGGGCTGA |
| | TniQ<br>(SEQ ID<br>NO: 1281) | ATGGAACCTGAGGCCGTGCAACACCCTCCTTGGTACGTGGAACCTAACGAGGGCGAGAGCATCAGCCACTACTTCG<br>GCAGATTCAGACGGCACGAGGCCGTGTGTGTTAGCTCTCCTGGCACACTGTCTAAGGCCGCTGGAATCGGACCTGTG<br>CTGGCCAGATGGGAGAAGTTCCGGTTCAACCCATTTCCGATCCAGAAAGAGCTGGAAGCCATTGCCAAGCTGATCG<br>GCCTGGACGTGGACAGAATTGCCCAGATGCTGCCTCCTAAGGGCGAGAAGATGAAGATGGAACCCATCAGACTGTG<br>CGCCGCCTGTTATGCCGAGCAGCCTTACCACAGACTGGAATGGCAATTCTGTGACCACCGTGGGCTGCGAGAGACAC<br>AAGCTGAGACTGCTGAGCGAGTGCCCCTTCTGCAAAGAGAGATTCGCTATCCCCGCTCTGTGGGAGAAGGGCGAGT<br>GCAAGAAATGTCACGCCCTGTTCCGGTCCATGGCCAAGAGACAGAAGGCCTACTGA |
| | Cas12k<br>(SEQ ID<br>NO: 1282) | ATGAGCAGCGACCGGAAGAAGAAAAGCACAATCCCCGTGCACCGGACCATCAGATGTCACCTGGATGCCAGCGAG<br>GACATCCTGCGGAAAGTGTGGGAAGAGATGACCCAGAAGACACCCCTCTGATCCTGAAGCTGCTGAAGTCCGTGT<br>CCGAGCAGCCTGAGTTCGAGGCCAACAAAGGAAGGCCGAGATCACCAAGAAAGATGTCAAGCTGCGGAAGA<br>ACGTGACCAAGAATCCCGAGCTGGAAGAACAGAGCGGCAGACTGAGAAGCAGCGCCGAGAGCTTCGTGAAGAGGG<br>TGTACAGCAGCTGGCTGACCCTGTACCAGAAGCGGAAGCGGCAGAAAGAGGGCAAAGAGTACTTCCTGAAGAACA<br>TCCTGAAGTCTGACGTCGAGCTGTGACGAGAGCAACTGCGACCTGGAAACCATCCGCAGCAAGGCCGAAGGT<br>GCTGTCTCAGCCCGAGGAATTCATCAAGCAGCTGCTGACCATCAACGACGAGGACGTGAAGCTACCAAGAGCGCCCGG<br>AAGAGAGTGAACAAGAACATCAACAACAAGAGCACCGACGCCGAGCAGCGAAGGATAGCAGCAGCACCAACAA<br>CGTGGACAAGAACAAGCTGGAAACCCTGACCAACATCCTGTACGAGATCCACAAGCAGACCCAGGACATTCTGACC<br>AGATGCACCTGGCCTACCTGATCAAGAACCACAACAAGATCAGCAACCTGGAAGAGGATATCCAGAAGCTGAAG<br>AAGCGGCGGAACGAGAAGATCGTGCAGATCAAGCGGCTGGAAAACCAGATCCAGGACAACAGACTGCCCAGCGGC |

TABLE 27-continued

| Name/<br>Organism/<br>System<br>ID (T) | | Sequences |
|---|---|---|
| | | AGAGATATCACCGGCGAGAGATACAGCGAGGCCTTCGGCAATCTGATCAATCAGGTGCCCAAGAACAATCAAGAGT<br>GGGAAGATTGGATCGCCAACCTGAGCAAGAAGATCAGCCATCTGCCTTATCCTATCGACTACCTGTACGGCGACCT<br>GAGCTGGTACAGAACGACGTGGGCAACATCTTCGTGTACTTCAACGGCTGGGAGCGAGTACCACTTCAAGATCTGC<br>TGCAACAAGAGACAGCGGCACTTCTTCGAGCGGTTTCTCGAGGACTACAAGGCCTTCAAGGTGTCCCAGAAAGGCG<br>AGGAAAAGCTGAGCGGCTCCCTGATCACACTGAGATCCGCTCAACTGCTGTGGCAACAAGGCGAAGGCAAGGGCG<br>AGCCTTGGAAGGTGCACAAACTGGCCCTGCACTGCACCTACGACAGCAGACTGTGGACAGCCGAGGGAACAGAGG<br>AAGTGCGCAAAGAGAAAACCGACAAGGCCCAGAAACGGGTGTCCAAGGCCGAAGAGAATGAGAAGCTGGACGAC<br>ATCCAGCAGACACAGCTGAACAAGGACAAGTCCAGCCTGAGCCGGCTGAAGAATAGCTTCAACAGACCCGGCAAG<br>CTGATCTACCAGAGCCAGTCCAACATCATCGTGGGCATCAGCTTTCACCCCATCGAGCTGGCCACAGTGGCTATCGT<br>GGACATCAATACCAAAAAGGTGCTGGCCTGCAACACCGTGAAACAGCTGCTGGGCAACGCCTTCCATCTGCTGTCT<br>AGACGGCGGAGACAGCAGGTCCACCTGTCCAAAGAGAGAAAGAAGGCTCAGAAGAAGGACAGCCCCTGCAACATC<br>GGCGAGTCTAAGCTGGGCGAGTATATCGACAAGCTGCTGGCCAAGCGGATCGTGGAAATCGCCAAGTTTTACCAGG<br>CCGGCTGCATCATCCTGCCTCGGCTGAAGGACATGAAGGAAATCCGGACCAGCGCATCCAGGCCAAAGCCGAGGC<br>CAAAATTCCTGGCGACGTGAACGCTCAGAAACTGTATGTGAAAGAGTACAACCGGCAGATTCACAACTGGTCCTAC<br>AACAGGCTGCAAGAGAGCATCAAGAGCAAGGCCGCCGAGTTTAAGATCTCCATCGAGTTCGGCATCCAGCCTCACT<br>ACGGCACCCTTGAGGAACAGGCCAAGGACCTGGCCTTCTACGCCTACCAGTCCAGAAATCACACCCTGGGCAGATG<br>A |
| | TracrRNA<br>(SEQ ID<br>NO: 1283) | AATTTCTACCCGAAGAATATAATCTTATTGAAATTTAAATCGGTGCCGTCATACATGCTCTTTTGAGCCTTAACTGTAT<br>GATGCTACAGTATTAACCCCTTTGTGTAGATACTGTGGAATGGGTTAGTTTAACGCTTGGAAAAGCGTATTCTTTCTG<br>ACCCTGGTAGCTGCCAACTCTACCTGTGCGATCATCTAAGCGTTTGTTAGTGGTAATTGCTGGGTAAGGTAATACT<br>GCTGTTAGATGAGAAAGTACTCGCACCGAGACGCATGGGAAGTATAAGGTGTTAGGGTTCCAAACAGCCCAGAACC<br>TTAGCTCTTGACATCAAACTCTTTTAGCTTGGTGTTAGGTGCCAGAGCGGCCTGTACTACTGAAATCTTAGATTTTGG<br>TTTTTATGAGGAGGATCATTACCTCTTACTTTACAACAAAGTAAGGGTACGGGTATACCGTCACGGTGGCTACCGAAC<br>TACCACCCCCTAATTTTTATTTTTGGCAGCTCAAAGCGGGGGCAAAATCCCTGGGGCGCTGCCAAATGTCCAAAAAT<br>CTTGTCTGCATTGGGTATTACTGTTTTAGTCATGAATAAAATTTTATTCATTGGCTGTAAAAAATAGGAATTAAAGG<br>AGGCTTGTCAATTTTGCCTTCAGAAGCCCTTGTTGGCAAGAGTTTTCACGGGTGCG |
| | DR<br>(SEQ ID<br>NO: 1284) | GTTTCCAAAGCCCTCTCGTTAGGTGGTGGGTTGAAAG |
| | sgRNA<br>(SEQ ID<br>NO: 1285) | AATTTCTACCCGAAGAATATAATCTTATTGAAATTTAAATCGGTGCCGTCATACATGCTCTTTTGAGCCTTAACTGTAT<br>GATGCTACAGTATTAACCCCTTTGTGTAGATACTGTGGAATGGGTTAGTTTAACGCTTGGAAAAGCGTATTCTTTCTG<br>ACCCTGGTAGCTGCCAACTCTACCTGTGCGATCATCTAAGCGTTTGTTAGTGGTAATTGCTGGGTAAGGTAATACT<br>GCTGTTAGATGAGAAAGTACTCGCACCGAGACGCATGGGAAGTATAAGGTGTTAGGGTTCCAAACAGCCCAGAACC<br>TTAGCTCTTGACATCAAACTCTTTTAGCTTGGTGTTAGGTGCCAGAGCGGCCTGTACTACTGAAATCTTAGATTTTGG<br>TTTTTATGAGGAGGATCATTACCTCTTACTTTACAACAAAGTAAGGGTACGGGTATACCGTCACGGTGGCTACCGAAC<br>TACCACCCCCTAATTTTTATTTTTGGCAGCTCAAAGCGGGGGCAAAATCCCTGGGGCGCTGCCAAATGTCCAAAAAT<br>CTTGTCTGCATTGGGTATTACTGTTTTAGTCATGAATAAAATTTTATTCATTGGCTGTAAAAAATAGGAATTAAAGG<br>AGGCTTGTCAATTTTGCCTTCAGAAGCCCTTGTTGGCAAGAGTTTTCACGGGTGCGGAAATCTCGTTAGGTGGTGGG<br>TTGAAAGNNNNNNNNNNNNNNNNNNNNNNN |
| | LE<br>(SEQ ID<br>NO: 1286) | TACCTTCTGGACATTGCCCACATCTGTCTCGTCCTGACCTTCTTGCCTCAATATTAACTAGTAATTAATTTTTTGATC<br>CATATTTTAGGAAATTAACCGAAGCGTATTGAGTGTGAACAAGGGAATATCTTTGAAATTTTAATTCGGCATAGACGA<br>ACGATATATTCTAATTAATAACGACATGAATTTGCAAATTGCGACATTGAATTTGCGAATGTACACATGGTGTCCAT<br>TAAATAATTATTGTCACTTTTAAAGAATTATTGTCCAGTTTTACGATATCTGTATAACAGGCTCAAAGGCTTACCAAA<br>CAAGTCTTTGAGCTATATTTATACTTTTATTATTCTCTAGCCAGTTTTAAAGTAAATGATGTCATTTTTCTGATAAAT<br>TTTTAAAGTAAATGATGTCATTTTTCTTGAAGACGGGTCAAGTGTATGTCTACGCGTTCTTTGAGTCAAGGCGCTAA<br>TCTCCCCGGTCATGAGGAAGTTCTTGCAACGGA |
| | RE<br>(SEQ ID<br>NO: 1287) | GCATATAGGGTGATAAATCCAAACCAATAACTTCCGCTTGCCAGAAAGCCTGTTTTAACATTAAAGTTGTGGAACCT<br>GTGCCGCAACCTAAATCAAGTATGCGTCGTGGTTTCACCTTGACGGCATCAACTAAAGCTTGACGGACAATACTTTC<br>ATTGCGTGGACAGACATATTGGGTAATCGGATCGTAAGTAACTGCTGCACTGGAATTGAGATATCCGCCTGTAACAC<br>CATGAAAATTTTGACTACTGTAGTACGCCGGAATTATCACATCATCTCGTTGGAAGCGATCGCTCTCTTTCTCCCAGT<br>CAATACTATCAGCGTAACGCCGTAACCCGTCTTCATCAATCAAAAGACGCACTACAGGGGATAAAAAACGTTCCCA<br>GATTGTATCTTGACGCACTACCATATTGTGTCAGAACTTTAAAAGTTTACTTAAGTAAAGTAATTTTCTTTACAAATT<br>TTAATACATTTATGAGACATCTGCTTTCTGTCTGTGGTATTGGCTTGACGCTTGTAATTATTTTAGTTACACTTGTAA<br>TACAAAGAAGCTACTCTCTAAAAGTAGTTCTTCAGCTTCACGAAAATTGAGCGAACAAAATGAAAGACAATATAACA<br>TTTAAATTGCTACAACTAACTAGTAGTATGTCAATTTGAAATCAATGCCTTACAACAAACCTACAGAACTTATTTCA<br>AAAACCAAATACTAGTCATATCGATAATAAGTTATAAGTCATATCGATACTTATCAGTGACATCCTCACCTACCTAA<br>AGGCGCGGTGATTCTGGAGTAATGAGTAATAAGTAATGAGTAAATACCCATTTTTCATCCACTCATTACTCATTACT<br>CCTTACTCATTACTCATTACTTTAAAGCATTGTGTGAACACAGGGCTTCAGATCCAAATATGTGGTGACATCGACT<br>CAATCAAATCTAAAATTCAAAATCAAAATAGAAACAATTATGCCATACGAAAAGTTAGAAATTACCACACC |
| JXCB01000008.1/<br>Tolypothrix<br>campylone<br>moides<br>VB511288/<br>T70 | TnsB<br>(SEQ ID<br>NO: 1288) | ATGCAGGATACCCACAGCAGCAAGACCCCTGCCAACAGCAATAGCACCCTGACCGAGACAAACGTGATCGTGTCCG<br>AGCTGAGCGACGAGGCCAGCCTGAAGATGGAAGTGATCCAGAGCCTGCTGGAGAGCCGGCGACAGAACAACATACG<br>CCCAGAGACTGAAGGAGCCGCCGAGAGCTGGAAAGTCTGTGCGGACAGTGCGGCGGCTGATCGACAAGCTGGG<br>AGAAGAGGGACTGATCGGCCTGACACAGACCGAGAGAAATGACAAGGGCAAGCACAGAGTGGACGAGAACTGG<br>CAAGAGTTCATCCTCAAGACCTACAAAGAGGGCAACAAGGGCAGCAAGCGGATGACCAGACAGCAGGTCGCCGTC<br>AGAGTGAAGGCCAGAGCTGATGAGCTGGGCGTGAAGCCTCCTAGCCACATGACCGTGTACAGATGCTGAAGCCCC<br>TGATTGACAAAGAGAAAAGGCCAAGAGCATCAGAAGCCCCGGCTGGCGAGGAAGCAGATGAGCGTCAAGACCA<br>GAGATGGCAAGGATCTGCAGGTCGAGTACAGCAATCAAGTGTGGCAGTGCGACCACACCAGAGTGGATGTGCTGCT<br>GGTGGATCAGCACGGCGAGATTCTTGGCAGACCTTGGCTGACCACCGTGATCGACAGCTACAGCAGATGCATCATC<br>GGCATCAACCTGGGCTACGACGCCCCTAGCTCTCAGATTGTGGCTCTGGCCCTGAGACACGATCCTCCGGCTAAGGAC<br>CTACGGCAGCGAGTATGGCCTGCACGAGGAATGGGCACATACGGACTGCCCGAGCACTTCTATACCGACGGCGGC<br>AAGGACTTCAGAAGCAACATCTGCAGCAGATCGGCGTGCACCTGGGCTTCGTGTGTCACCTGAGAGTGTCTAAGG<br>CCCCTCCATTCGCTCAGAGACTGCGGAGAAGGCAAGAGGCCAGACCTTCTGAAGGCGGCATCGTGAAAGACCCTT<br>CAAGACCTTCAACACCGAGCTGTTCAGCACCCTGCCTGGCTACACAGGCAGCAACGTGCAAGAGAGGCCTCAAGAG<br>GCCGAGAAAGAAGCCTGTCTGACCCTGAGGCAGCTGGAACAGCAGCTCGTGCGGTACATCGTGAACCACTACAACC |

TABLE 27-continued

| Name/<br>Organism/<br>System<br>ID (T) | Sequences |
|---|---|
| | AGCGGCTGGACGCCAGAATGGGCGATCAGACCAGATTTCAGAGATGGGAGAGCGGCCTGATCGCCACACTGGATCT<br>GCTCAGCGAGAGAGATCTGGACATCTGCTTTATGAAGCAAACCCGCAGACAGATCCAGAGAGGCGGCTACCTGCAG<br>TTCGAGAACCTGATGTACCGGGGCGAGTACCTGGCTGGATATGCCGGCGAATCTGTGGTGCTGAGATACGACCCCA<br>GAGACATCACCACCATCCTGGTGTACCGGAAAGAAGGCGACAAAGAAGTCTTTCTGGCCAGGGCCTACGCTCAGGA<br>CCTGGAAACAGAGCAGCTGAGCATCGATGAGGCCAAGGCCAGCTCTAGACAAGTGCGGAAGGCCGGCAAGACCGT<br>GTCCAACAGATCTATCCTGGCCGAGATCAGAGAGCGGGAAACCTTTAGCACCCAGAAAAAGACCAAGAAAGAGCG<br>GCAGAAGATCGAGCAGGCCGAGGTGCAGAAAGCCAAGCAGCCCATCAGAGTGGAACCCGAGGAACAGGTGGAAGT<br>GGCCAGCATTGATGCCCAGACCGAGCCTGAGATGCCCGAGGTGTTCGACTACGAGCAGATGAGAGAAGATTACGGC<br>TGGTGA |
| TnsC<br>(SEQ ID<br>NO: 1289) | ATGACCACACAAGAGGCCCAGGCTGTTGCTCAGCAGCTGGGAGAGATCCCCGTGAACGATGAGAAGCTGCAGAAA<br>GAGATCCAGCGGCTGAACCGGAAGGGCTTCGTTCCTCTGGAACAGGTGCAGATCCTGCACGACTGGCTGGAAGGCA<br>AGAGACAGAGCAGACAGTCCGGCAGAGTTGTGGGCGAGAGCAGAACGGCCAAGACCATGGGCTGTGACGCCTACC<br>GGCTGAGAAACAAGCCTAAGCAAGAGGCCGGCAAGCCTCCTACAGTGCCCGTGGCCTATATCCAGATTCCTCAAGA<br>GTGCGGCGCCAAAGAACTGTTCAGCGTGATCCTGGAACACCTGAAGTACCAAGTGATCAAGGGCACCGTGGCCGAG<br>ATCAGAGACAGAACCCTGAGAGTGCTGAAAGGCTGCGGCGTGAAATGCTGATCATCGACGAGGCCGACCGGTTCA<br>AGCCCAAGACCTTTGCTGAAGTGCGGGACATCTTCGACAAGCTGGAAATCTCCGTGATCCTCGTGGGCACCGACAG<br>ACTGGATGCCGTGATCAAGAGGGACGAACAGGTGTACAACCGGTTCCGGGGCTGCCACAGATTTGGCAAATGAGC<br>GGCGAGGACTTCAAGCGGACCGTGGAAATCTGGGAGAAGAAGGTGCTGCAGCTGAGCGTGGCCAGCAACCTGAGC<br>AGCAAGACAATGCTGAAAACCCTGGGCAAGCCACCAGCGGCTATATCGGACTGCTGGACATGATCCTGAGAGAG<br>AGCGCCATCAGAGCCCTGAAGAAAGGCCTGCAGAAGGTGGACCTGGAAACCCTGAAAGAAGTGGCCGCCGAGTAC<br>AAGTGA |
| TniQ<br>(SEQ ID<br>NO: 1290) | ATGGAAGTGACCGAGATCCAGAGCTGGCTGTTCAGAGTGGAACCCCTGGAAGGCGAGAGCCTGTCTCACTTCCTGG<br>GCAGATTCAGACGGGCCAACGATCTGACACCAACCGGCCTGGGAAAAGCCGCTGGACTTGGCGGAGCTATTGCTTA<br>TGGCGGAGCCCTGCCTATCGCCAGATGGGAGAAGTTCAACCCTCCACCTAGCCGGCAGCAACTGGAAGCC<br>CTGGCTACAGTCGTGGGAGTCGATGCCGATAGACTGGAACAGATGCTGCCTCCTACCGAAGTGGGCATGAAGATCG<br>AGCCCATCAGACTGTGCGGCGCCTGTTATGCCCAGTCTCCTTGCCACAAGATCGAGTGGCAGTTCAAAGTGACCCAA<br>GAGTGCGCCAGCCACAAGCTGAGACTGCTGAGCGAGTGCCCTAATTGCGGCGCCAGATTCAAAGTGCCCGCTCTGT<br>GGGGTTGACGGCTGGTGCCAGAGAAGCTTCCTGACCTTCGTGGAAATGACCCGCTACCAGAAAAGCGTGTGA |
| Cas12k<br>(SEQ ID<br>NO: 1291) | ATGAAGCGGAGCCAGTACCAGCTGGAAGGCAAGACCAGATGGCTGGAAATGCTGAGAAGCGACGCCGAGCTGCTG<br>GAAGCTAGCGGAGTTGCTCTGGACAGCCTGCGGATCAAGGCCAACGAAATTCTGGCCCAGTTCAGCCCTCAGAGCG<br>CCCCTGTTGAGGCCAAGCAGAAGAAGGGCAAGACCGGCAAGAAAACCAGAAAGAGCCAGAACAGCGACAACAAT<br>CGGAGCCTGAGCGCCACACTGTTCCAGGCCTACAGAGACACCGAGGACGAACCTGACCAGATGCGCCATCAGCTACC<br>TGCTGAAGAACGGCTGCAAGGTGTCCGACAAAGAAGAGGACCCCGAGAAGTTCGCCCAGCGGAGAAGAAAGATCG<br>AGATCCAGATCGAGCGGAAGAGAGAGCAGCTCGAGGCCAGGATTCCCAAGGGCAGAGATCTGACCGATACCACCT<br>GGCTCGAAACCCTGTTCCTGGCCACACACCAGGTGCCAAACAATGAGGCCCAGGCCAAGAGCTGGCAGAACAGCCT<br>GCTGAGACAGAGCAGCAGCGTGCCATTTCCTGTGGCCTACGAGACTAACTCCGACATGACCTGGTTCAAGAACCAC<br>AAAGGCCGGATCTGCGTGAAGTTCAACGGCCTGAGCGAGCACACCTTCGAGGTGTACTGCGACCAGAGATACCTGC<br>ACTGGTTCCAGCGGTTTCTGGAAGATCAGCAGATCAAGCACGAGAGCAAGAACCAGCACAGCAGCAGCCTGTTCAC<br>CCTGGAGATCTGGCAGAATCGCCTGGCTTGAAGGCGAGGACAAGGGCGTTAGAGGATCTGCTGCAGGCGCCCCT<br>TGGAACATCCACAGACTGAGCCTGTACTGCTGCGTGGACACCAGACTGTGGACCGATGAGGGCACAGAACTCGTGC<br>GGCAAGAGAAGGGCCGAGGGAAATCGCCAAGACCATCACCAAGACCAAAGAAGGGCGACCTGAACGAAGCAG<br>CTGGCCCACATCAAGCGGAAGAACAGCACCCTGGCCAGAATCAACAACCCATTTCCACGGCCTAGCAAGCCCCTGC<br>ACAAGGGACAGTCTCATGTGCTCGTGGGAGTGTCTCTGGGCCTCGAGAAACCTGCTACAGTGGCCGTGGTGGATGC<br>CACAACAGGCAAGGTGCTGACCTACCGGTCGCATCAAACAGCTGCTGGGCGACAACTACAAGCTGCTGAACCGGCAG<br>CAGAAGCAGAAACACAGCCTGAGCCACAAGCGGCAGATCGCCCAAACACTGGCCGCTCCTAATAGATTCGGCGAG<br>AGCGAGCTGGGCCAGTACGTTGACAGACTGCTGGCCAAAGAAATCGTGGCTATCGCCCAGGCCTATAGCGCCGGAT<br>CTATCGTGGTGCCTAAGCTGGGAGAACATGCGCGAGCAAGTGAACTCTGAGATTCAGGCCAAGGCCGAGCAGAAATG<br>CCCCGAGTGTCTGGAAGCCCAGAAGAACTACGCCAAGCAGTACCGGCACAGCGTGCACCAGTGGTCTTACGGCAGA<br>CTGATCAGCAGCATCTGCAGCTCTGCTGCCCAGGCCGGAATCGTGATCGAAGGGGAAAGCAGCCCATCAGAGGCA<br>GCCCTCACAACAAAGCCAAAGAACTGGCCATTGCCGCCTACCACAGCAGAAAGAACAGCTGA |
| TracrRNA<br>(SEQ ID<br>NO: 1292) | TACACAAACTTTCTTCCGAACCTTGAAAATAAAATAAGTAATCAACAGCGCCGTTGTTCATGCGTAAATACGCCTCT<br>GAACAATGATAAATGTGGGTTAGTTTGACTGTTGTCAAACAGTCTTGCTTTCTGACCCTGGTAGCTGCCCACCTTGA<br>AGCTGCTATCCCTTATGGATAGGAATCAGGTGCGCCCCCAGTAATAGAGGTGCGGGTTTACCGCAGTGGCGGCTACT<br>GAATCACCTCCGAGCAAGGAGGAACCCACCTTAATTATTTTTTGGCAAGCCAAAGCGGGAGCGATTTACCGGGAGC<br>CATGCCAAAGTTTTAAATCTCTTGTTTAGCGAGATTTCTAGCCTTTGAAGTTTCAGTTGATTTACTTTTTTAAGTGT<br>TGACTGACAGGCGATTTTGGCAGCCTTGACAAAAATGCCTCCGGAAATTTTGACAAATCAGGGGTTTGAAGCGCACA |
| DR<br>(SEQ ID<br>NO: 1293) | GTTTCAATGCCCCTCCTAGCTTGAGGCGGGTTGAAAG |
| sgRNA<br>(SEQ ID<br>NO: 1294) | TACACAAACTTTCTTCCGAACCTTGAAAATAAAATAAGTAATCAACAGCGCCGTTGTTCATGCGTAAATACGCCTCT<br>GAACAATGATAAATGTGGGTTAGTTTGACTGTTGTCAAACAGTCTTGCTTTCTGACCCTGGTAGCTGCCCACCTTGA<br>AGCTGCTATCCCTTATGGATAGGAATCAGGTGCGCCCCCAGTAATAGAGGTGCGGGTTTACCGCAGTGGCGGCTACT<br>GAATCACCTCCGAGCAAGGAGGAACCCACCTTAATTATTTTTTGGCAAGCCAAAGCGGGAGCGATTTACCGGGAGC<br>CATGCCAAAGTTTTAAATCTCTTGTTTAGCGAGATTTCTAGCCTTTGAAGTTTCAGTTGATTTACTTTTTTAAGTGT<br>TGACTGACAGGCGATTTTGGCAGCCTTGACAAAAATGCCTCCGGAAATTTTGACAAATCAGGGGTTTGAAGCGCACA<br>GAAATCCTAGCTTGAGGCGGGTTGAAAGNNNNNNNNNNNNNNNNNNNNNNNNN |
| LE<br>(SEQ ID<br>NO: 1295) | GAATTAGAGTAAATCGTCAAGACTACTTAAGCAAGTTCACAACCTAATTAACCAAAAACTATACGTAGGATATCCA<br>TCTGATACCTAAAAACTACAATTTTGAAGTATCATATGCCCTCAAAAGTTTAATTTTTAGTGTACATTCACTAATTAT<br>TTGTCAATTTAACAAAATATTGTCAAAATACGTGTAAATGACTGAAACCCTGCTGTAACAAAGCTTATGGCAGGTTT<br>TTAATTATTAAACTTCTCACAACCACCGTTAAACGCGATTCACAAATTAGATGCTAATCCCTGAAATTTAACAATTT<br>AAGTGTCACTTTCCAGAAACAAGGAAAATTACTAAGTTTTAGAAAACTTAACAGATTAAATGTCACTCTGGATAGGT<br>AGAATAGACATATATGTTGCAATTAAACAAATGTGTATATGCAGGACACTCATTCTTCTAAAACCTGCAAACTCA<br>AATAGCACTCTCACCGAAACAAATGTCATTGTGTCGG |

TABLE 27-continued

| Name/<br>Organism/<br>System<br>ID (T) | | Sequences |
|---|---|---|
| | RE<br>(SEQ ID<br>NO: 1296) | GTTACAACAACCCTCCCGGATAGGGGCGGGTTAAAAGAGCATTACTATGTTCCGCAAGCTAGGCTCAAAATTCCAA<br>TATATTCTTTAAATATAGGTGGGTTGAAAGAGGTCACGAGTTCAATCTTCTTCGTTGAAAGTAGAATTATAAATGA<br>ACTCAGCAATGTTGACATTTAATTCGTTAAAACTAGAAAACTAGTAATTATTTGTCGATAACTGTGCAAGCCAGGTG<br>AAGTGACAATTATTCTGTTAACAGTGACATTAACTGTTAAAAGTGACATCAATCTGTTAACAGTGACAAATAATTA<br>GTTAGGGCTTGCTGAAAAAGAAAGAAAAGGCAGCATTCTATGATTTTTAGAGCAGAGATATGTATTCAAGTGCAAG<br>AAAAAAGGCTATAATACTCTGAAACCCTTGCATCACCGTAAGCTCCTGGTATACTTAGTAGCTTAAGTAACGATGTA<br>CCGAAAAAAGGAACCAACTCAAATTCCACCGGAAAGCTTT |
| KI928193.1/<br>Aphanizomenon<br>flosaquae<br>NIES-81/<br>T71 | TnsB<br>(SEQ ID<br>NO: 1297) | ATGAGCGGCTTTCACAGCATGGCCGACGAGGAATTCGAGTTCACCGAGGACAGCACCCAGGTGCCAGAAGCCATCC<br>TGCTGGACAAGAGCAACTTCGTGGTGGACCCCAGCCAGATCATCCTGGCCACAAGCGACAGACACAAGCTGACCTT<br>CAACCTGATCCAGTGGCTGGCCGAGTCTCCCAACAGAACCATCAAGAGCGCAGCGGAAGCAGGCCGTGGCCAACACA<br>CTGGATGTGTCCACCAGACAGGTGGAACGGCTGCTGAAGCAGTACGACGGAGACAGTGAGAGAGACAGCCGGC<br>ATCGAGAGAGCCGACAAGGGCAAGTACGAGTGAACGAGTACTGGACAGAACTTCATCAAGACCATCTACGAGAAG<br>TCCCTGAAGGACAAGCACCCTATCAGCCCCGCCAGCATCATCAGAGAAGTGAAGAGACACGCCATCGTGGACCTGG<br>GCCTGAAGCTGGGAGATTATCCACACCAGGCCACCGTGTACCGGATCCTGGATCCTCTGATCGAGCAGCACAAGAG<br>AAAGACCAGAGTGCGGAATCCTGGCAGCGACAGCTGGATGACAGTGGTCACAAGAAAGGGCGAGCTGCTCAAGGC<br>CGACTTCAGCAACCAGATCATTCAGTGCGACCACACCAAGCTGGACGTGCGGATCGTGGACAACCACGGCAATCTG<br>CTGAGCGAGAGGCCTTGGCTGACCACCATTGTGGACACCTTCTCCAGCTGCGTCGTGGGCTTCAGACTGTGGATCAA<br>GCAGCCTGGCTCTACCGAAGTGGCCCTGGCCTTCAGACATGCCATTCTGCCCAAGAACTACCCCGAGGACTACCAGC<br>TGAACAAGACTGGGATGTGTGCGGACACCCCTACCAGTACTTTTTCACCGACGGCGGCAAGGACTTCAACAGCA<br>GCACATCAAGGCCATCGGCAAGAAACTGGGCTTCCAGTGCGAGCTGAGGGACAGACCTCCTGAAGGCGGCATCGTG<br>GAACGGATCTTTAAGACCATCAACACCCAGGTCCTGAAGGATCTGCCTGGCTACACAGGCGCCAACGTGCAAGAAA<br>GACCCGAGAACGCCGAGAAAGAGGCCTGCCTGACAATTCAGGATCTGGATAAGATCCTGGCCTCCTTCTTCTGCGA<br>CATCTACAACCACGAGCCGTATCCTAAAGAGCCCCGGGACACCATCCAGATTCGAGCGGTGGTTTAAAGGCATGGGCGGC<br>AAGCTGCCTGAGCCTCTGGATGAGAGAGAGCTGGACATCTTCCTGATGAAGGAAGCTCAGAGAGTCGTCCAGGCTC<br>ACGGCTCCATCCAGTTCGAGAACCTGATCTACCGGGGCGAGTTCCTGAAGTCCCACAAGGGCGAGTATGTGACCCT<br>GAGATACGACCCCGACCACATCCTGAGCCTGTACATCTACAGCGGCGAGACAGACGACAATACCGAAGAGTTCCTG<br>GGCTACGCCCACGCCATCAACATGGACACACACGACCTGAGCATCGAGGAACTGAAGGCCCTGAACAAAGAGCGG<br>AGCAACGCCCGGAAAGAGCACTGCAATTACGACGCCCTGCTGGCCCTGGGCAAGAGAAAAGAACTGGTGGAAGAA<br>CGCAAAGAGGACAAGAAGGCCAAGCGGAACAGCGAGCAGAAGAGACTGAGAAGCGCCAGCAAAAAGGACAGCAA<br>CGTGATCGAGCTGCGGAAGATCAGAGCCAGCAAGAGCAGCAAGAAACAAGAGAATCAAGAGGTGCTGCCCGAGCG<br>GATCAGCCGGGAAGAACGGCACAAGCTGGTGTTCAGCAACAGACGGAAGAACCTCAACAAGATCTGGTGA |
| | TnsC<br>(SEQ ID<br>NO: 1298) | ATGGCTCAGCCTCAGCTGGCCACACAGAGCATCGTGGAAGTGCTGGCCCCTCGGCTGGATATCAAAGCCCAGATCG<br>CCAAGACCATCGACATCGAGGAAATCTTCCGGGCCTGCTTCATCACCACCGACAGAGCCAGCGAGTGCTTCAGATG<br>GCTGGACGAGCTGCGGATCCTGAAGCAGTGCGGCAGAATCATCGGCCCCAGAAACGTGGGCAAGAGCAGAGCTGC<br>CCTGCACTACAGAGATGAGGACAAGAACGGGTGTCCTACGTGAAGGCTTGGAGCGCCAGCAGCAGCAAGAGACT<br>GTTCAGCCAGATTCTGAAGAACATCAACCACGCCGCTCCTACCGGCAAGACCCAGGACTCTTAGACCTAGACTGGCC<br>GGCAGCCTGGAACTGTTCGGACTGGAACTGGTCATCATCGACAACGCCGAGAACCTGCAGAAAGAGGCCCTGCTGG<br>ACCTCAAGCAGCTGTTCGAGGAATGCAACGTGCCCATCGTTCTGGCTGGCGGCAAAGAGCTGGACGAACTTCTGCA<br>GGACTGCGACCTGCTGACCAACTTTCCCACACTGTACGAGTTCGAGCAGCTGGAATACGACGACTTCAAGAAACCC<br>CTGACCACCATCGAGCTGGACATCCGTGTCTCTGCCCGAGGCCTCTAATCTGGCCGAGGGCAACATCTTCGAGATCCT<br>GGCCTTCAGCACCAACGCCAGAATGGGCATCCTGATCAAGATCCTGACCAAGGCCGTGCTGCACAGCCTGAAGAAC<br>GGCTTCCACAGAGTGGACGAGTCCATCCTGGAAAAGATCGCCAGCAGATACGGGACCAAGTACATCCCTCTGGAAA<br>ACCGGAACCGGGACTGA |
| | TniQ<br>(SEQ ID<br>NO: 1299) | ATGCTGGTGGTTATGGCCCAGAACATCTTCCTGAGCAAGACCGAGATCGGCATCGACGAGGACGACGAGATCAGAC<br>CCAAGCTGGGCTACGTGGAACCTTACGAGGGCGAGAGCATCAGCCACTACCTGGGCAGACTGCGGAGATTCAAGGC<br>CAACAGCCTGCCTAGCGGCTACAGCCTGGGAAAGATTGCTGGACTGGGCGCCATGATCAGCAGATGGGAGAAGCTG<br>TACTTCAACCCGTTTCCTACACCTCAAGAGCTGGAAGCCCTGTCTAGCGCCGTGGGAGTGAATGTGGACCGGCTGAT<br>GGAAATGCTGCCCAGCCAGGGCATGACCATGAAGCCCAGACCTATCGACTGTGCGCCGCCTGTTATGCCGAGTCT<br>CCTTGCCACAGAGTGGAATGGCAGCTGAAGGACCGGATGAAGTGCGACCGGCACAACCTGCGGTTTCTGATCAAGT<br>GCACCAACTGCGAGACACCCTTTCCTATACCTGCCGACTGGGTCAAGGGCGAGTGCCCTCACTGCTTTCTGAGCTTC<br>ACCAAGATGGCCAAGCGGCAGAAGCGGGACTAA |
| | Cas12k<br>(SEQ ID<br>NO: 1300) | ATGAGCGTGATCACCATCCAGTGCAGACTGGTGGCCGAAGAGGACAGCCTGAGACAGCTGTGGGAGCTGATGACCG<br>AGAAGAACACCCCTTTCATCAACGAGATCCTGCTGCACCTGGGCAAGCACCCCGAGTTTGAGACATGGCTGGAAAA<br>GGGCAGAATCCCCGCCGAGAGCCTGAAAAACCCTGGGCAACTCCCTGAAAACACAAGAGCCCTTCACAGGCCAGCCT<br>GGCAGATTCTACACAAGCGCTATCGCCCTGGTGGACTACCTGTACAAGAGTTGGTTCGCCCTGCAGAAGCGGCCGGA<br>AGAATCAGATCGAGGGCAAGCAGCGGTGGCTGAAGATGCTGAAGTCTGACCCCGAGCTGGAACAAGAGAGCCAGA<br>GCAGCCTGGAAGTGATCAGGACCAAGGCTCACCGAGCTGTTCAGCAAGTTCACCCCTCAGAGCGATAGCGAGGCCCT<br>GCGGAGAAACCAGAACGACAAGAGCAAGAAGGGCAAAAAGACCAAGAAGCCCACAAAGGCCAAGACCAGCTCCA<br>TCTTCAAGATTCTGCTGAACACCTACGAGGAAGCCGAGGATCCCCTGACCAGATGTGCCCTGGCCTACCTGCTGAAG<br>AACAACTGCAGATCAGCGAGCTGGACGAGAACCCCGAGAATTCACCCGGACAACAGCGGAGAAAAGAGATCGAG<br>ATCGAGCGGCTGAAGGACCAGCTGCAGAGCAGGATTCCCAAGGGCAGAGATCTGACAGGCGAGCAGTGGCTGAA<br>ACCCTGGAAATCGCCACCGTGAAGGTGCCCCAGAACGAGAATGAAGCCAAGGCCTGGCAAGCCGCTCTGCTGAGA<br>AAGACCGCCAACGTGCCATTTCCTGTGGCCTACGAGAGCAACGAGGACATGACCTGGCTGAAAAACGATAAGAACC<br>GGCTGTTCTGCGGTTCAACGGCCTGGGAAAGCTGAACTTCGAATCTACTGCGACAAGCGGCATCTGCACTACTTC<br>CAGCGGTTTCTGGAAGATCAAGAGATTCTGCGGAGCACGCCAAGCGGCACACGCAGCAGTCTGTTCACACTGAAGA<br>GCGAGCAGAATCGCCTGGCTGCCTGGCGAGGAAAAGGCGAGCACTGGAAAGTGAACAGCTCAACTTCTACTGCTC<br>CCTGGACACCGGATGCTGACCACAGAGGGAACACAGCAGGTCGTGGAAGAGAAAGTGACCGCCATCACAGAGAT<br>CCTGACCAAGCAAGCAGAAGCAAGCCGAGAATCAAGAAGCCTTCATCACCCGGCAGCAGCACACAT<br>GAGCCGGATCAACAACCCATTTCCTCGGCCTAGCAAGCCCAACTACCAGGGCAAGAGCAGCATCCTGATCGGCGTG<br>TCCTTCGGACTGAAAAGCCTGTGACAGTGGCCGTGGTGGACGTGTCAAGAATCAAGTGATCGCCTACGAAGCG<br>TGAAACAGCTGCTGGGCGAGAACTACAATCTGCTGAATCGGCAGAGACAGCAGCAACAGAGACTGAGCCACGAGA<br>GACACAAGGCCCAGAAGCAGAACGCCCCTAACAGCTTTGGCGAGTCTGAGCTGGGCCAGTACGTGGACAGACTTCT<br>GGCCGACGCCATCATTGCCATTGCCAAGAAGTACCAGGCCGGCTCCATCGTGCTGCCCAAGCTGAGAGATATGAGA TABLE 27-continued

| Name/<br>Organism/<br>System<br>ID (T) | | Sequences |
|---|---|---|
| | | GAGCAGATCAGCAGCGAGATCCAGTCCAGAGCCGAGAACCAGTGTCCTGGCTACAAAGAGGGCCAGCAGAAGTAC<br>GCCAAAGAATACCGCATCAACGTGCACCGGTGGTCCTACGGCAGACTGATCGAGAGCATCAAGAGCCAGGCTGCCC<br>AGGCCGGAATCGCCATTGAAACTGGCACCCAGCCTATCCGGGCCTCTCCACAAGAGAAGGCTAGAGATCTGGCCCT<br>GTTCGCCTACCAAGAGAGACAGGCCGCTCTGATCTGA |
| | TracrRNA<br>(SEQ ID<br>NO: 1301) | TTTACTAATCCGAACCTTGAAAATATAATATAGATACAATAGCGCCGTAGTTCATGCTCCTTGGAATCTCTGTACTAT<br>GAAAAATCTGGCTTAGTTTGGCAGTTGGAAGACTGTCATGCTTTCTGAGCCTGGTAGCTGCCCGCTTCTGATGCTGC<br>TGTCGCAAGACAGGATAGGTGCGCTCCCAGCAATAAGGAGTAAGGCTTTTAGCCCTAGTCGTTTTTATAACGATGTG<br>GATTTCCACAGTGGTGGCTACTGAATCACCCCCTTCGTCGGGGGAATCCTCCCAAATCTTTTTTTGGCAAACCATAA<br>GCGGGGTCAAAAACCCTGGGAATCTGCCAAAACCTTGAATCCCTTGTCCAGTATTGATTTGACTCATTTGAAGAGTG<br>ATGAATGTCCTCAATTGAGAGCAAAAAAACAGATTTTTTAACAGGTTTGCCAAAATCGCATCTGGAAACCTGTATTG<br>GCAAGGGTCTAGACGGGCGCG |
| | DR<br>(SEQ ID<br>NO: 1302) | GTTTCAACTACCATCCCGACTAGGGGTGGGTTGAAAG |
| | sgRNA<br>(SEQ ID<br>NO: 1303) | TTTACTAATCCGAACCTTGAAAATATAATATAGATACAATAGCGCCGTAGTTCATGCTCCTTGGAATCTCTGTACTAT<br>GAAAAATCTGGCTTAGTTTGGCAGTTGGAAGACTGTCATGCTTTCTGAGCCTGGTAGCTGCCCGCTTCTGATGCTGC<br>TGTCGCAAGACAGGATAGGTGCGCTCCCAGCAATAAGGAGTAAGGCTTTTAGCCCTAGTCGTTTTTATAACGATGTG<br>GATTTCCACAGTGGTGGCTACTGAATCACCCCCTTCGTCGGGGGAATCCTCCCAAATCTTTTTTTGGCAAACCATAA<br>GCGGGGTCAAAAACCCTGGGAATCTGCCAAAACCTTGAATCCCTTGTCCAGTATTGATTTGACTCATTTGAAGAGTG<br>ATGAATGTCCTCAATTGAGAGCAAAAAAACAGATTTTTTAACAGGTTTGCCAAAATCGCATCTGGAAACCTGTATTG<br>GCAAGGGTCTAGACGGGCGCGGAAATCCCGACTAGGGGTGGGTTGAAAGNNNNNNNNNNNNNNNNNNNNNNNN |
| | LE<br>(SEQ ID<br>NO: 1304) | CAGCTTTTGCTTTACCCCTACTACACATCTGGGTTCTTTGTCATTTGGCAAAAGTTTAAATCTCACCCGTGTTTAGTA<br>TACATGTACATTCGCAAATTATATGTCGCATTTCGCAAGTCATGTCGCAACTGCTTTTAAGGGCTAGAACCTTTATTA<br>TATAAGCATCATAAGTTTATTTACCCCTACAAAAGACAAAATTACCTAATTCGCATATTGTATGTCGCAAAACCTAATT<br>TCGCAAATTAAACGTCGGTTGTTAAGATTTTGGTATTTGCAAATTAGATGTCGCATTTTGAGAGATTCATGGTACA<br>TTAGTACCTTAATCATTCATGAGTGGGTTTCACTCTATGCAGACGAAGAATTTGAATTCACTGAAGACTCGACGCA<br>AGTTCCAGAAGCTATTTTGCTTGACAAGAGTAATTTTGTCGTAGATCCATCCCAAATTATTCTGGCAACGTCGGATA<br>GGCATAAACTGACATTTAATTTAATCCAGTGGCT |
| | RE<br>(SEQ ID<br>NO: 1305) | GTTTCAACTAGCATCCCGACTAGGGGTGGTTAAAAATATAGGTTATTGACTTGCGTTAACCATTAAAATGGTTGCAA<br>AATAGAAATGATCATGGTGGAGGGTTGAAAGGAGTGCTGCGATCGAACACATATTAATAATCAAATTAATGCCCTTGC<br>AGCAATAATTTATTGTATTGTGTAGTCAATGTTAAGTTCATGCGACATTAATTTGCGAAAACTTAGAATAATTAAAT<br>TGACTCAGAAAAACAACCACCGCGACATTAATTTGCGAAGAACGACATTAATTTGCGAACTGCGACATATAATGTG<br>CGAATGTACACAAATGGAGAATAGGAGACTCGAACCCCTGACCTCTGCGGTGCGATCGCAGCACTCTACCAACTGA<br>GCTAATTTCCCTTAGTCGTGCTTAAGTCAAAAACTTTAGCACACTATATATCTTAACACTCAGGAAGGACAGATTTC<br>ACATCTTTTTCCAAAAAAACTTCCTGTACCTGCTGCAAATC |
| MRCD01000011.1/<br>Calothrix<br>sp. HK-06/<br>T73 | TnsB<br>(SEQ ID<br>NO: 1306) | ATGACCCACGCCTCTATCGCCGACGTGGAAAATGGAAAGGCCGAGGCCAACATCATCGTGTCCGAGCTGTCTGATG<br>AGGCCCTGCTGAAGATGGAAGTGATCCAGACACTGCTGAAAAACAGCGACTGCAGCACCAGAGGCGAGCTGCTGA<br>AACAGTCTGCCGAGAAGCTGGGCAAGAGCGTGCGGACAGTTAGACGGCTGGTGGACAAGTGGGAGAAAGAAGGAC<br>TGGCCGGACTGGTGCAGAACCAGAGAGATGATAAGGGCAAGCACCGCGTGAACAAGTACTGGCAAGAGTTCGTGC<br>TGACCACCTACAAAGAGAACAACAAGGGCAGCAAGCGGATGACCCGGCAGCAGGTTTTCATCAGAGCCAAGGCCA<br>GAGCCGACGAGCTGGGAATTGAACCTCCTAGCCACATGACCGTGTACCGGATCCTGAAGCCTCTGATCGACAAGCA<br>AGAGCAGGCCAAGAGCATCAGAAGCCCTGGCTGGCGAGGCAGCAGACTGAGCGTGAAAACCAGAGATGGCAAGGA<br>TCTGCAGGTCGAGCACAGCAATCAAGTGTGGCAGTGCAGCACCAGAGTGGATGTGCTGCTGGTGGATCAGCAT<br>GGCAAGATCCTGAGCAGACCCTGGCTGACCACAGTGATCGACAGCTACAGCCGGTGCATCATGGGCATCAACCTGG<br>GCTACGATGCCCCTAGCTCTACCGTGGTTGCTCTGGCCCTGAGACACGCCATTCTGCCCAAGCAGTACAGCAGCGAG<br>TACGGCCTGCACGAGGAATGGGGCACATATGGCCTGCCTCAGAACTTCTACACCGACGGCGGCAAGGACTTCAGAA<br>GCAACCATCTGCAGCAGATCGGCGTGCAGCTGGGCTTCGTGTGTCACCTGAGAGACAGACCTAGCGAAGGCGGCAG<br>CGTGGAAAGACCCTTCAAGACCCTGAACACCGAGCTGTTCAGCACCCTGGCCGGCTACACAGGCAGCAATGTGCAA<br>GAGAGGCCTGAGGGAAGCCGAGAAAGAGGCCTGTCTGACACTGAGCAATGTGGAAAAGATGCTCGTGCGGTACATC<br>GTGGACAACTACAACAGCGGATCGACGCCAGAATGGGCGACCAGACCAGGTTTCAGATGGGAGTCTGGCCTG<br>ATCGCCATGCCTGATCTGCTGAGCGAGAGAGATCTGGACATCTGCCTGATGAAGCAGACCAGACGGCAGATTCAGA<br>GAGGCGGCTACCTGCAGTTCGAGAACCTGATCTATCGGGGAGAGCTGCTGGCCGGATATGCCGGCGAATCTGTGGT<br>GCTGAGATACGACCCCAAGGACATCACAAAGATCCTGGTGTACAGAATGAGCGAGGGCAAAGAGATCTTCCTGGCC<br>AGAGCTTACGCCCAGGACCTGGAAGCCGAAGACTGTCTCTGGATGAGGCCAAGCTCCAGCAGAAAGTGCGC<br>GAAACAGGCCAAGGCCATCAACAACCGGTCTATCCTGGCCGAGATCCGGGAAAGAGACATTCCTACACAGAAG<br>AAAAACCCGGAAAGAGCGGCAGAAGCTGGAACAGACCGAAGTGAAGAAGGCCAAGCAGCTGACCCCTGTGGAAACC<br>GAGAAGGCCATCGACGTGGTGTCCATCGATGCCAAGCCTACCGGCAAGAACCCAGTGGAAAGCGAGCTGTGTACCG<br>AGTCCGGCGAGCTGGATATGCCTGAGGTGCTGGACTACGAGCAGATGCGCGAGGACTATGGCTGGTGA |
| | TnsC<br>(SEQ ID<br>NO: 1307) | ATGGTGGCCAAAGAGCCCAAGAGGTTGCCAAGCAGCTGGGCGACATCCCCGTGAATGATGAACAGCTGCAGGCC<br>CAGATCCACCGGCTGAACAGAAAGGGCTTCGTGCCCCTGGACAGGTGCAGACACTGCACGATTGGCTGGAAGGCA<br>AGCGGCAGTCTAGACAGTCTGGCAGAGTTGTGGGCGAGAGCAGAACCGGCAAGACCATGGGCGTGACGCCTACC<br>GGCTGAGAACAAGCCTAAGCAAGAGGCCGGCAAGCCTCCTACAGTGCCCGTGGCCTATATCCAGATTCCTCAAGA<br>GTGCGGCGCCAAAGAACTGTTCGGCGTGATCATGGAACACCTGAAGTACCAAGTGACCAAGGGCACCGTGGCCGAG<br>ATCAGACAGAACCCTGAGAGTGCTGAAAGGCTGCGGCGTGGAAATGCTGATCATCGACGAGGCCGACCGGTTCA<br>AGCCCAAGACCTTTGCTGAAGTGCGGGACATCTCGACAAGCTGGAAATCCCTGTGATCCTCGTGGGCACCGACAG<br>ACTGGATGGCGTCATCAAGAGGGACGAACAGGTGTACAACCGGTTCAGAGCTGCCACAGATTCGGCAAGCTGAGC<br>GGCGAGGAATTCAAGCGGACCGTGGAAATCTGGGAGAAGAAGGTGCTGCAGCTGCCTGTGGCCAGCAACCTGAGC<br>AGCAAGACAATGCTGAAGTCCCTGGGCAAGCCACCGGCGATATATCGGACTGCTGGACATGATCCTGAGAGA<br>GCGCCATCAGAGCCCTGAAGAAGGGACTGCAGAAGATCGACCTGGACACCCTGAAAGAAGTGACCGCCGAGTACC<br>GGTGA |

TABLE 27-continued

| Name/<br>Organism/<br>System<br>ID (T) | | Sequences |
|---|---|---|
| | TniQ<br>(SEQ ID<br>NO: 1308) | ATGGTCGAGGAAGAGTACATCAAACCCTGGCTGTTCCAAGTGGAACCCTTCGAGGGCGAGAGCCTGTCTCACTTCCT<br>GGGCAGATTCAGACGGGCCAACGAACTGACACCTGGCGGACTGGGAAAAGCCACAGGACTCGGCGGAGCCATTGC<br>CAGATGGGAGAAGTTCCGGTTCAACCCTCCACCTGATGGCCAGCAGCTGGAAAAGCTGGCCGTGGTCACAGCCATC<br>AACGTGGACAGACTGACCCAGATGCTGGCCCCTCCTGGAACAGGCATGAAGCTGGAACCCATCAGACTGTGCGGCG<br>CCTGTTATGCCGAGTCTCCCTGTCACAAGATCGAGTGGCAGTTCAAAGAGACACAGGGCTGCAAGCACCACAAGCT<br>GAGACTGCTGAGCGAGTGCCCTAATTCGGCGCCAGATTCAAGGTGCCCGCTCTGTGGATGGATGGCTGGTGCCAC<br>AGATGCTTCACCCCTTTCGTGGAAATGGTCAAGTGGCAGAAGCAGACCAACCACTGA |
| | Cas12k<br>(SEQ ID<br>NO: 1309) | ATGAGCCAGATCACCATCCAGTGCAGACTGGTGGCCAGCGCCAGCACCAGACAGAAACTGTGGAAGCTGATGGCCG<br>AGCTGAACACCCCTCTGATCAACGAGCTGCTGATCCTGGTGTATCAGCACCCCGATTTTGAGGCCTGGCGGCACAA<br>GGCGCTATCCCTGTGGGAACCATCAAGCAGCTGTGCGAGCCCCTGAAAACCGACGCCAGATTTGTGGGCCAGCCTG<br>GCAGATTCTTCGCCTCTGCCATTGCCACCGTGTCCTACATCTACAAGAGCTGGATCAAGATCCAGAAGCGGCTGCAG<br>CTCCAGATCGACGGCCAAGACCAGATGGCTGGAAATGCTGAACAGCGACCACCGAGCTGGTGGAAATGGCTGGCGTG<br>GCACTGGATACCCTGAGAGCCACAGCTACCGAACTGCTGAACCAGCTGAACCCTCAGCCTAAGACCGAGGAAAGCC<br>CCAACAAGAAGGGCAAAAAGACCAAGAAACCCAGCGAGCCAGGGCGAGAGAAGCCTGAGCAAGATCCTGTTCG<br>ACACCTACGGCGATACCGAGGACATCCAGACAAGATGCGCCATCTCCTACCTGCTGAAGAACGGCTGCAAGATCCG<br>CAGCCAAGAAGAGGACAGCAAGAAGTTCGCCAAGCGGCGGAGAAAGGTGGAAATCCAGATCCAGATCTGACCGA<br>CCAGCTGGCCTCCAGAGTTCCCAAGGGCAGAGATCGACAGCCGCCAAGTGGCTGGAAGCCCTGTCTATCGCCGCC<br>TGCAAGGTGCCAGAGAATGAGGCCGAAGCCAAGTCCTGGCAGAACGCCCTGCTGAGACAGAGCAGCAGCTGCCA<br>TTTTCCGTGGCCTACGAGACAAGCGAGGACATGGCCTGGTTCTCCAAGCTGAAGCTGAACCACATCAGCATCAAGC<br>TGTGGAACATCCCTCTGTACATCGACTACCTGGTGGTGCCCTGTTCGTGCGGGACAGCCTGAAGAATGAGATGCTG<br>TGGTTCAAGAACCTGAAGATCAACAACAGCGACGTGCTGATGCAGCTGTGGTTTACCCAGCTGAATATCAACTGCCT<br>GGCCGGCATCCTGTTTCTGAATGGCATCCTGAAGAAGTACAAGAAGCGGATCTGCGTCCACTTCAACGGCCTGAGC<br>GATTGCACCTTCGAGATCTACTGCGACAGCCGGCACCTCCACTGGTTCAAGCGGTTTCTGGAAGATCAGCAGATCAA<br>GAAGAACTCCAAGAACCAGTACAGCAGCTCCCTGTTCACCCCTGCGGAGCGAGAATTGCCTGGCAGTCTGCTGAA<br>GGCAAGGGCAAGCCCTGGAACATCAACCACCTGACACTGAGCTGCACCGTGGACACCAGACTGTGGACAGCCGAA<br>GGATCTCAGCTGGTGGCCGAAGAGAAGCCCTGGAAATTACCAAGAGCATCACCCGGACCAAAGAGAAAGAGACA<br>AAAGAGAAGATCAAGCTGAACGACAACCAGCTCGCCTACATCAAGCGGAAGGACGCCACACTGACCCGGATCAGC<br>AACCCATTTCCTCGGCCTAGCCAGCCACTGTACAAGGGCCAGTCTCACATCCTCGTGGGAGTGTCTCTGGGCCTCGA<br>GAAACCTGCTACACTGGCCGTGCTGAATGCCGTGACCGGCAAGATCATTGCCTACCGGTCTATCAAACAGCTGCTGG<br>GCGAGAACTACAAGCTGCTGAATCGGCAGAGATACCAGAAGCAGGTCCTGAGCCACCAGCGGAAGATCGCTCAAA<br>CACTGGCTGCCCCTAACCAGTTCGGCGATTCTGAGCTGGGAGAGTACATCGATCGGCTGCTGGCCAAAGAGATTATC<br>GCTCTGGCCCAGAAGTTCAACGCCGGCTCTATCGTGGTGCCCAACTCTGGACAACATGCGCGAGCAAGTGAACTCCG<br>AGATCCAGGCCAAGGCCGAAGAAAAGTGTCCCGAGAGCATCGAAGCCCAGAAGAAATACGCCAGCAGCTACAGGC<br>GGAGTGTGAATCAGTGGTCCTACCGGCGGCTGATCGACTGCATCACAAATCAGGCCGCCAAAGCCGGCATCGTGAT<br>CGAGGAAAGAAGCAGCCCATCCGGGGCAGCCCTCAGGACAAAGCTAAAGAGCTGGCCCTGAGCGCCTACCACGC<br>CAGAAAGAAGTCTTGA |
| | TracrRNA<br>(SEQ ID<br>NO: 1310) | TTTAAAAAACCGAACCTTGAAAATATAATAGTCATTAACAGCGCCGCAGTTCATGCGCCTTACGCGCCTCTGTGCT<br>GTGCAAAATGTGGGTTAGTTTGACTGTTGTCAGACAGTCTTGCTTTCTGACCCTGGTAGCTGCCCACCTTGAAGCTGC<br>TATCCCTTGTGGATAGGAATCAGGTGCGCCCCAGTAATAGAGGTGCGGGTTTACCGCAGTGGTGGCTACCGAATC<br>ACCTCCGAGCAAGGAGGAACCCACCTTAATTTTTATTTTTGGCAAAGCAAAGCGGGAGCTATTTTACCGGGACTGGC<br>GCCAAAACTTTAAACTCCTTATTTAACAAAGCTTTTGGATAAGGCACTGTCAGTTGATTTATTTTTTTAGTTTTAACT<br>AACAAGCGATTTTGTCTGCCATGCCAAATTTGCTTCTCAGAATCTTGATAAGTAAGGAGTCTGAAGCATGGA |
| | DR<br>(SEQ ID<br>NO: 1311) | GTTTCAGCGTCCATCTCAGCTTGAGGCGGGTTGAAAG |
| | sgRNA<br>(SEQ ID<br>NO: 1312) | TTTAAAAAACCGAACCTTGAAAATATAATAGTCATTAACAGCGCCGCAGTTCATGCGCCTTACGCGCCTCTGTGCT<br>GTGCAAAATGTGGGTTAGTTTGACTGTTGTCAGACAGTCTTGCTTTCTGACCCTGGTAGCTGCCCACCTTGAAGCTGC<br>TATCCCTTGTGGATAGGAATCAGGTGCGCCCCAGTAATAGAGGTGCGGGTTTACCGCAGTGGTGGCTACCGAATC<br>ACCTCCGAGCAAGGAGGAACCCACCTTAATTTTTATTTTTGGCAAAGCAAAGCGGGAGCTATTTTACCGGGACTGGC<br>GCCAAAACTTTAAACTCCTTATTTAACAAAGCTTTTGGATAAGGCACTGTCAGTTGATTTATTTTTTTAGTTTTAACT<br>AACAAGCGATTTTGTCTGCCATGCCAAATTTGCTTCTCAGAATCTTGATAAGTAAGGAGTCTGAAGCATGGAGAAAT<br>CTCAGCTTGAGGCGGGTTGAAAGNNNNNNNNNNNNNNNNNNNNNNNN |
| | LE<br>(SEQ ID<br>NO: 1313) | CAGAATGGCAAAGAAGTAGTTTAAAACTGGCACCGCTCAAAAGTGCTGTTTGTAAAGGTTGGTGCCGATAATCTC<br>TAAAGCAGCAGTTCGTGTTGTACATTAACTAATTATTTGTCAATTTAACAAATTATTGTCACAAATGTAGGAAATCC<br>TGAAAACCCTGCCATCTAAAGGTTTGTGGCAGGTTTTTTATTATTTTAAGATTCCAAGCCTGTCAAAGCTTAATTAAC<br>ATATTAACTGTCAAATCCCAGAAATATAACACATTAATTGTCAGTTCCCAAAAATCAAACAAATTAATGATTTTATA<br>AAATTTAACAAATTCTTTGTCCATTTATTAATATAATACAACTATGTTTTTATAAAACACATCTATGAAGGATGCAAA<br>ATCTACTACAAACTCTGCAATGACACATGCCAGCATTGCGGATGTAGAAAACGGTAAAGCAGAAGCAAATATTATT<br>GTTTCTGAACTGTCAGATGAAGCTTTGTTAAAAATGGA |
| | RE<br>(SEQ ID<br>NO: 1314) | GTTTCAACGTCCATCTCAGCTTGAGACGGGTTGAAAGATTAGATACCCCAAGTAAGGATCCTCCCCTTCTTTGTTTC<br>TATTTTATTAAATAAGGTTTAATTATTTAAAATGAATATTTGATACTTGTAGTAATGGTTAATGTTATCGGTATTAAC<br>CACAGTGCTATTCTACTGTGGAAACTGGTCAGTTATTTTGCCAGCCTGCACTAGCTCCGGGACCTAATCTGTTAAT<br>ATTGACATCAATCTGTTAAATGTGACATTAATTGTTAAGAGTGACAAATAATTAGTTAATGTACACGTGTATCAGA<br>ATATGGTATTAGTAAATTTACCAGAACTTAAAGTGGAGTTGTTTGAATGACTGAACCACATAAAGCTAACGGTAAT<br>GCGGTTGAAGCTTGGCCAAGTCTACCATTCGATAAATGGAAGGACACGTATGCAACACTCCATATGTGGACTCAAA<br>TTATTGGAAAAATTCGACTTGTGCAAAGTCCATTCT |
| Ga0209902_<br>100058/<br>T74 | TnsB<br>(SEQ ID<br>NO: 1315) | ATGGGCGAGACACTGAACAGCAACGAGGTGGACGAGAGCCTGGTGCTGTACGATGGCTCTGACAAGTGGATGAG<br>ATCAGCGAGAGCGAGGACACCAAGCAGAACAACGTGATCGTGACCGAGCTGAGCGAAGAGGCCAAGCTGAGAATG<br>GAAGTGCTGCAGACCCTGATCGAGCCCTGCAGAAAGACCTACGGCATCAAGCTGAAGCAGGCCGCCAGAGAA<br>CTGGAAAGCCGTCAGAACAGTGCAGCGGCTGGTCAAGAAGTACCAAGAGCAGGGACTGAGCGGCGTGACAGAG<br>GTGGAAGATCTGACAAAGGCGGCTACCGGATCGACGACGACTGGCAGGACTTCATCGTGAAAACCTACAAAGAG<br>GGCAACAAAGGCGGACGGAAGATGACCCCTGCTCAGGTGGCCATCAGAGTGCAAGTTCGCGCTGGACAGCTGGGC<br>CTCGAGAAGTACCTTGTCACATGACCGTGTACCGGGTGCTGAACCCCATCATCGAGCGGAAAGAACAGAAACAGA<br>AAGTGCGGAACATCGGCTGGCGGGGCAGCAGAGTTTCTCACCAGACAAGAGATGGCCAGACACTGGACGTGCACC |

TABLE 27-continued

| Name/<br>Organism/<br>System<br>ID (T) | Sequences |
|---|---|
| | ACAGCAATCACGTGTGGCAGTGCGACCACACCAAGCTGGATGTGATGCTGGTGGACCAGTACGGCGAAACCCTGGC<br>TAGACCTTGGCTGACCAAGATCACCGACAGCTACAGCCGGTGCATCATGGGCATCCACCTGGGCTTTGATGCCCCTA<br>GCTCTCTGGTGGTGGCCCTGGCTATGAGACACGCCATGCTGAGAAAGCAGTACAGCAGCGAGTACAAGCTGCACTG<br>CGAGTGGGGCACATATGGCGTGCCCGAGAACCTGTTTACCGACGGCGGCAAGGACTTCAGAAGCGAGCACCTGAAG<br>CAGATCGGCTTCCAGCTGGGATTCGAGTGTCACCTGAGAGACAGACCTCCAGAAGGCGGCATCGAGGAAGAGGCT<br>TCCGGAACAATCAATACCGACTTCCTGAGCGGCTTCTACGGCTACCTGGGCAGCAACGTGCAAGAGAGAGCTGAGGG<br>CGCCGAGGAAGAGGCCTGTATCACACTGAGAGAACTGCATCTGCTGATCGTCGGTACATCGTGGACAACTACAAC<br>CAGAGAATCGACGCCAGAAGCGGCAACCAGACCAGATTCCAGAGATGGGAAGCCGGCCTTCCTGCTCTGCCCAACC<br>TGGTCAACGAAAGAGAGCTGGACATCTGCCTGATGAAGAAACCCGGCGGAGCATCTACAAAGGCGGATACGTGT<br>CCTTCGAGAACATCATGTACCGGGCGACTACCTGTCTGCCTATGCCGGCGAATCTGTGCTGCTGAGATACGACCCC<br>AGAGACATCAGCACCGTGTTCGTGTACAGACAGGACAGCGGCAAAGAGGTCCTGCTGTCTCAGGCCCACGCCATCG<br>ATCTGGAAACCGAGCAGATCAGCCTGGAAGAGACAAAAGGCCGCCAGCAGAAAGATCCGGAATGCCGGCAAGCAGC<br>TGAGCAACAAGTCTATCCTGGCCGAGGTGCAGGACCGGGACACCTTTATCAAGCAGAAGAAGAAGTCCCACAAAG<br>AGCGGAAGAAAGAGGAACAGGCCCAAGTCAACTTCGTGAAGCCTCCTCAGACCAACGAGCCCGTGGAAACCGTGG<br>AAGAGATCCCTCAGCCTCAGAAAAGACGGCCCAGAGTGTTCGACTACGAGCAGCTGCGGAAGGACTACGACGATTG<br>A |
| TnsC<br>(SEQ ID<br>NO: 1316) | ATGGCCGAGGACTACCTGAGAAAATGGGTGCAGAACCTGTGGGCGACGACCCCATTCCTGAAGAACTGCTGCCCA<br>TCATCGAGCGGCTGATCACACCTAGCGTGGTGGAACTGGAACACATCCAGAAGATCCACGACTGGCTGGACAGCCT<br>GAGACTGAGCAAGCAGTGCGGCAGAATTGGCCCCTCCTAGAGCCGGCAAGAGCGTGACATGTGACGTGTACAAG<br>CTGCTGAACAAGCCCCAGAAGAACCGGCAAGCGGGACATTGTGCCCGTGCTGTATATGCAGGTCCCCGGCGAAT<br>GTTCTGCCGGCGAACTGCTGACACTGATCCTGGAAAGCCTGAAGTACGACGCCATCAGCGGCAAGCTGACCGACCT<br>GAGAAGAAGAGTGCTGCGGCTGCTGAAAGAAAGCAAGGTGGAAATGCTCGTGATCGACGAGGCCAACTTCCTGAA<br>GCTGAACACCTTCAGCGAGATCGCCCGGATCTACGACCTGCTGAAGATCAGCATCGTGCTCGTGGGCACCGACGGC<br>CTGGACAACCTGATCAAGAAGAGCCCTACATCCACGACCGGTTCATCGAGTGCTACAGACTGCCTCTGGTGTCCG<br>AGAAGAAATTCCCCGAGTTCGTGCAGATCTGGGAAGATGAGGTGCTGTGCCTGCCTGTGCCTAGCAATCTGACCAA<br>GCGCGAGACACTGATGCCCCTGTACCAGAAAACCTCCGGCAAGATCGGCCTGGTGGACAGAGTTCTGAGAAGGGCC<br>GCCATCCTGAGCCTGAGAAAGGGCCTGAAGAATATCGACAAGGCCACACTGGACGAGGTGCTCGAGTGGTTCGAAT<br>GA |
| TniQ<br>(SEQ ID<br>NO: 1317) | ATGGAAATCCCTGCCGAGCAGCCCAGATTCTTCCAGGTGGAACCTCTGGAAGGCGAGAGCCTGTCTCACTTCCTGGG<br>CAGATTCAGAAGAGAGAACTACCTGACCGCCACACAGCTGGGCAAGCTGACAGGCATTGGAGCCGTGATCAGCAG<br>ATGGGAGAAGTTCTACCTGAATCCGTTTCCGACACCTCAAGAGCTGGAAGCCCTGGCCGCTGTGGTGGAAGTGAAA<br>GTGGACCGGCTGATCGAGATGCTGCCTCCTAGAGGCGTGACCATGAAGCCCAGACCTATCAGACTGTGCAGCGCCT<br>GCTACCAAGAGTCCCCTTGCCACAGAGTGGAATGGCAGTTCAAGGACGTGATGGTCTGCGACTGCCTGAGACACTG<br>CCCTCTGAACAACAGACACCAGCTGGCCTGCTGACCAAGTGCACCAATTGCAGAGCACCCTTTCCTATACCTGCCG<br>ACTGGGTGCAGGGCGAGTGCCCTCACTGTTTTCTGCCCTTCACCAAGATGGCCAGACGGCAGAAGCGGTACTGA |
| Cas12k<br>(SEQ ID<br>NO: 1318) | ATGAGCGTGATCACCATCCAGTGCAGACTGGTGGCCGACGACAAAGCCCTGAGACACCTGTGGGAACTGATGGCCG<br>AGAAGAACACCCCTCTGGTCAACAGCTGCTGGACAGACTGGGCAAGCACACCGATTTTGAGGCCTGGGTGCAAGC<br>CGGCAAGGTGCCAAAGACAACCATCAAGGGCCCTGTGCGACAGCCTGAAAACCCAAGAGCCTTTCATCGGCCAGCCA<br>GGCAGATTCTACACCAGCGCCACAACTCTGGTGGCCTACATCTACAAGTCGTTGGCTGGCCCTGCACAAGCGGCGGC<br>AGAGAAAGATTGAGGGCAAAGAACGGTGGCTGGAAATGCTGAAGTCCGACGTGGAACTGGAACAAGAGAGCAACA<br>GCAGCCTGGAACTGATCCGGACAATCGCCACCGAGATCCTGAGCAAGTTTAGCGCCAGCAGCACCGACGGCATCAA<br>CCAGAGTCCAAGGGCAAGAGTCTAAGAAGCTGAAGAAGGACAAGGCCGACGAGCCCATGAGCATCAAACCTGG<br>CGTGCTGTTCGAGGCCTACCAGAAAACCGAGGACATCCTGCGGAGAAGCGCCCTGGTGTACCTGATCAAGAACAAC<br>TGCCAAGTGAACTTCGCCAAGAGGACCCCGATAAGTACGCCAAGATGCGGCGGAAGAAAGAGATCGAGATCGAG<br>CGGCTGAAAGAGCAGCTGAAGTCTCGGGTGCCCAAGGGCAGAGATCTGACCGGAAAGAAGTGGCTCGAGACACTG<br>GAAAAGGCCGTGAACAGCATCCCTCAGGACGAGAACGAGGCCAAATCTTGGCAGGCCGGACTGCTGAGAAAGTCC<br>AGCACCGTGCCATTTCCAGTGGCCTACGAGACTAACGAGGACATGCACTGGGAGATCAGCGATAAGGGAAGAATCT<br>TCGTGTCCTTCAACGGCCTGTCCAAGCTGAAGCTGGAAGTGTACTGCGACCAGCGGCATCTGCCCTGGTTCCAGAGA<br>TTCGTGGAAGATCAAGAGACAAAGCGCAAGGGGAAGAACCAGCACAGCAGCGGCCTGTTCACACTGAGAAGCGGC<br>AGACTGAGCTGGCTGAAGCAAGAAGGCAAGGGCGAACCTTGGAGCGTGAACCGGCTGATCCTGTTCTGTAGCGTGG<br>ACACCAGAATGTGGACCGTGGAAGGCACACAGCAGGTCGCCATCGAGAAGATCGCCGATGTGAACGAACCTGA<br>CCAAGGCCAAAGAGAAGGGCGAGCTGAACAGCAACCAGCAGGCCTTCGTGACCAGACAGCAGAGCACACTGGCCA<br>AGATCAACACCCCATTTCCACGGCCTAGCAAGCCCCTGTACGAGGGCAAGTCTCACATCCTCGTGGGAGTGTCTCTG<br>GGCCTCGAGAATCCTGCTACCGTGGCCGTGTTCGACGCTGTGAACAACAAGGTGCTGGCCTACAGAAGCGTGAAAC<br>AGCTGCTGGGCAACAACTACAACCTGCTGAACCGACACAGCAGCAAGCAGACAGAGACTGTCCCACGACAGACACA<br>AGGCCCAGAAGGACTTCGCCAGAAACGACTTCGGCGAGTCTGAGCTGGGCCAGTATGTGGATAGACTGCTGGCCAA<br>AGAAATCGTGGCCATTGCCGTGACCTACTTCGCCGGCTCTATCGTGCTGCCTAAGCTGGGCGACATGAGAGAGATCA<br>TCCAGAGCGAGGTGCAGGCCAGAGCCGAGAAAAAGATCCCCGGCTTCAAAGAGGGCCAGCAGAAATACGCCAAAG<br>AATACCGGAAACAGGTGCACAACTGGTCCTACGGCAGGCTGATCGAGAATATCCAGAGCCAGGCCGCCAAAGTGG<br>GCATCCTGATTGAGACAGGCCAGCAGCCAATCCGGGGCTCTCCACAAGAACAGGCTAGAGATCTGGCCCTGTTCGC<br>CTACCAGTGTAGGATCGCCAGCTCCATCTGA |
| TracrRNA<br>(SEQ ID<br>NO: 1319) | TCAATCTAAACAAAATACCGAACCTTGAAAACTTAATATGAAAGTAACAGCGCCGCAGTTCATGCTCTTCTGAGTCT<br>CTGTACTGTGATAAATCTGGGTTAGTTTAACGTTGAAAGACCGTTTTGCTTTCTGACCCTGGTAGCTGCTCGCTCTT<br>GATGCTGCTGTCTTTTGACAGGATAGGTGCGCTCCCAGCAATAAAGAGTTAAAGCTGATAAAGCTTGAGCCGTTGTA<br>AAACGGTGGGGTTACCTCCAGTGGTGGCTACTGAATCACCCCCTTCGTCGGGGGAACCCTCCTAAATATTTTTTTTG<br>GCGTGTCAAAGCGGGGGCAAAAATCCTGGAGTCCCGCCAAAATCTCAAAACCTTTGTCCTATCTTGACTTGATAAAC<br>TAGCATGTCAGTTAATTTAGTTTTTTGATGTCAAGTAGGAGATGCTTTTAGGCAGTCCTGCCAAAGATGTGTATGGA<br>AAGCTCTAATAGCAAGGGTTCTAGACGGATCG |
| DR<br>(SEQ ID<br>NO: 1320) | GTTTCAACAACCATCCCAGCTAGGGGTGGGTTGAAAG |

TABLE 27-continued

| Name/<br>Organism/<br>System<br>ID (T) | | Sequences |
|---|---|---|
| | sgRNA<br>(SEQ ID<br>NO: 1321) | TCAATCTAAACAAAATACCGAACCTTGAAAACTTAATATGAAAGTAACAGCGCCGCAGTTCATGCTCTTCTGAGTCT<br>CTGTACTGTGATAAATCTGGGTTAGTTTAACGGTTGAAAGACCGTTTTGCTTTCTGACCCTGGTAGCTGCTCGCTCTT<br>GATGCTGCTGTCTTTTGACAGGATAGGTGCGCTCCCAGCAATAAAGAGTTAAAGCTGATAAAGCTTGAGCCGTTGTA<br>AAACGGTGGGGTTTACCTCAGTGGTGGCTACTGAATCACCCCCTTCGTCGGGGGAACCCTCCTAAATATTTTTTTG<br>GCGTGTCAAAGCGGGGGCAAAAATCCTGGAGTCCCGCCAAAATCTCAAAACCTTTGTCCTATCTTGACTTGATAAAC<br>TAGCATGTCAGTTAATTTAGTTTTTTGATGTCAAGTAGGAGATGCTTTTAGGCAGTCCTGCCAAAGATGTGTATGGA<br>AAGCTCTAATAGCAAGGGTTCTAGACGGATCGGAAATCCCAGCTAGGGGTGGGTTGAAAGNNNNNNNNNNNNNNNN<br>NNNNNNNNN |
| | LE<br>(SEQ ID<br>NO: 1322) | AGTTTTGTGTTGCACAAACCATCCTAAGCGACATTAGTTTGCAAAAAACGACATTAATTTACGAATCGCGACCTTTA<br>ATTTGCGAATATACAACAGATTTTGTCGATTAACTAATTATTTGTCGTCTTAACAAATTAATGTCGCCCAAATCTTCA<br>AGACTATAATCCTTATGTATCAAAGGTTATAGCCTTTTGAACTTATATTGGCTATCATCAAATATTTAACTAATTAAG<br>TGTCGTCTTTTAATTAATTAACATTTTAAATGTCGTTTTTTCAAAAAACACCTTTCCAAATTTTTCTTTTGCTCATAA<br>CAAATAACTCTGTCGTCTTTTGGAAGTGAGTGAAAAATAAAATTAAATGTCGCTTTTTGGAACAAAGTAGTATGATA<br>TTTATTAGGCAATAGTAGCTATGTAACAACAAAAACATAGTTAGATTGAAGTCTTCTTTTTTGTCTCTAGCTACGAA<br>GTCATTACCCTTGCTGCGATTAAATTTAGACGCAAGCTAATTTCGCTCTTAGACTTGCTGTACCGTATTGCCTAACCA<br>ACTAGTTTCAAGCGATGAAGTTTGTTTATGGGTGAAACGCTAAACTCCAACGAGGT |
| | RE<br>(SEQ ID<br>NO: 1323) | GTTTCAACAACCATCCCGGCTAGGGGTGGGTTGAAAGTTTAAGTTCTATTAACTCCAAGTTTTAATAATTGCATGGC<br>AATAACAATCCTTTTTAGAAAGGATTTAAGAGGGTTGAAAGGAATGTCACCTTCCCAAGAATACTTTTCAAAAGCTA<br>TTTTGGGTTAGGGAAGAATAATCACAGATAACTAATATGCACAAGTAAGTCTAAAATAGGGATAAGTCTGTCGATT<br>AGTCCAATAGCAAGGCATCTTGTTAGACGACATTAATTTGTTAACGTTAGTTGGAACTAATTCGACGACATTAATTC<br>GTTAACAGCGACATTAATTTGTTAATGACGACATTAATCTGTTAACGACGACATTAATCTGTTAACGACGACAAATA<br>ATCTGTTAATTGACAGATTTGAAAGCGGGTGATGGGACTCGAACCCACGACGTTCACCTTGGGAAGGTGACATTCTA<br>CCACTGAATTACACCCGCAAATGGAGTTTAGGCTCAATA |
| a0167663_<br>1001047/<br>T75 | TnsB<br>(SEQ ID<br>NO: 1324) | ATGACACTGGTGCTGCACACCATCAGCATCTTCGTGCTGCTGACCGAGAGCAGATTCGCCTCTCCTCCTCTGCTGGC<br>CAACTTCCTGTCTAGCAGCAAGCTGTTCCAGAAAGAGAGCGGCATCTTCATCCTGTTCACCCTGAAGTGGCAGCAGC<br>CCAGCATGGATGAATCCCAGGTGGCCTGCCTGGATGCCGATCCTCAGGATTTCGATGAGGTGGTGCTGAGCAGCCA<br>CGCCTTCGATACCGATCCTAGCAAGATCCTGATCGACAGCAGCGACCGGCACAAGCTGCGGTTCAGACTGATTGAG<br>TGGCTGGCCGAGGCTCCCAACAGAAAAGTGAAGGCCGAGAGAAAGGGCGCCATCGACAAGACCCTGGACATCAGC<br>ACCAGACAGGTGGAACGGGATGCTGAACCAGTACAACGCCGACAAGCTGAGAGAGACAGCCGGCATCGAGAGAGCC<br>GACAAGGGCAACCACAGAATCGACGAGTACTGGCAGGACTACATCCGCGAGGTGTACGAGAAGTCCCTGAAGGAC<br>AAGCACCCTCTGAAGCCCGCCGATGTTGTGCGGGAAGTGCATAGACACGCCGTGATCGACCTGAGACACGAGGAAG<br>GCGATTGGCCTCACGCCGCCACCGTGTACAGAATCCTGAAGCCTCTGGTCAAGCGGCACAAGAGGAACCAGAAGAT<br>CAGAAACCCTGGCAGCGGCAGCTGGCTGGCTGTGAAGACGAAGATGGCAGGCTGCTGAAGGCCAATTTCAGCAA<br>CCAGATCGTGCAGTGCGACCACACCAAGCTGGACATCCGGATCATCGACAAGGACGGAAAGCTGCTGTCTTGGAGG<br>CCTTGGCTGACCACCGTGGTGGACACCTTTAGCAGCTGCCTGATCGGCTACCAGCTGTGGCACAAACAGCCTGGCGC<br>TCACGAAGTGGCCCTGACACTGAGACATGCCATCCTGCCTAAGCAGTACCCCGCCGACTACGAGCTGGAAAAGCCC<br>TGGAATATCTACGGCGCTCCCCTGCAGTACTTCTTCACCGACAAAGGCAAGGACCTGAGCAAGAGCAAGCTGATCA<br>AGGCCCTGGGCAAGAAACTGGGGCTTCCAGTGCGAGCTGAGGGACAGACCTATCCAAGGCGGCATCGTGGAACGGCT<br>GTTCAAGCACATCAACACCGAGGTGCTGGCCTCCTCTGCCAGGCTACATCAGCAAAGAAGAGGACGGCGCTGAGCGG<br>GCCGAAAAGAGGCCTGTTTTACCATCGAGGACATCGATAAGATCCTGGCCAGCTACTTCTGCGACGACTACAACC<br>ACCAGCCTTATCCTAAGGACCCTCACGACACCAGATTCGAGCGGTGGTTTAGAGGCATGGGCAACAAGCTGCCCGA<br>GCCTATGGATGAGCGCGAGCTGGATGTGTGCCTGATGAAGGAAGAACAGAGAGTCGTTCAGGCCCACGGCAGCGTG<br>TACTTCGAGAACCTGACCTACAGATGCGAGGAACTGCGGAGCCTGAAGGGCGAGTACGTGACCGTGACCTACGATC<br>CCGACCACATTCTGACCCTGTACATCTACCGCGAGACCACCTCTGATGAGGCCGGCGAGTTTATCGGATACGCCCAC<br>GCCATCAACATGGACACCCAGGATCTGAGCCTGGACAGCTGAAGCAGCTGAACAAAACCAGAAGCAGCGCCAAG<br>AGAGAGCACAGCAATTTCGACGCCCTGGTGTCCCTGGACAAGAGACAGAAACTGGTGAAGAGAGGAAGCAAGAG<br>AAGAAAGAGCGGCAGCGGAGCGAGCAGAAGAAGCTGAGGGGAAAGTCCAAGCAGGACAGCAAGGTGGTGGAACT<br>GAGAAAGGACAGAGCCGGCAAGAGCACAAACCCCACCGAGTCCATGGAACTGCTGCCTGAGAGAGTGTCCCCTGA<br>GCAGATGAAGCCACTGAGCCCTCCAACACCTCCTATTCCAGAACCTGCCGCCCAGCGCTCCTTCTACACAAGAAAGA<br>CACAAGCTCGTGATCCCCAAGAATCAGACCCTGAAGCGGATCTGGTGA |
| | TnsC<br>(SEQ ID<br>NO: 1325) | ATGGCTCAGCCTCAGCTGGCTGTGCATGTGCCTGTGGAAGTTCTGGCCCCACAGCTGGATCTGACAGACGTGCTGGC<br>CAAGACAGCCGCCATCGAGGAACTGTTCAAGACCGCCTTCATTCCCACCGACAGAGCCAGCCAGTACTTCAGATGG<br>CTGGACGAGCTGCGGCTGCTGAAGCAGTGTGGAAGAGTGATCGGCCCCAGAGATGTGGGCAAGAGCAGATCCTCCG<br>TGCACTACAGAGAAGAGGACCGGAAGCGGATCAGCTGCGTGAAGGCCTGGTCTAACAGCAGCAGCAAGCGGCTGT<br>TCAGCCAGATCCTGAAGGACATCAACCACGCCGCTCCTCGGGGCAAGACAGGATCTGAGATCTAGACTGGCCGG<br>CTGCCTGGAACCTTTCGGAATCGAACTGCTGCTGATCGACAACGCCGAGAACCTGAGAGAGAGGCCCTGATCGAT<br>CTGAAGCAGCTGCACGAGGAATCCGGCGTGCCAGTGATTCTCGTTGGAGGCCAGGACCTGGATAGCAGCCTGCAGA<br>ATCTGGACCTGCTGACCTGCTTTCCCACACTGTTCGACTTCGACCGGCTGGACTACGACGACTTCCAGAAAACCCTG<br>CGGACCATCGAACTGGATCTGCTGGCACTGCCCCAGCCTAGCAATCTGTCTGAGGGCACCGTTGTTGAGATCCTGGC<br>CACATCTACCCAGGCCAGAATGGGCGTGCTGATCAAGACCTGACCAAGACCGTGCTGCACAGCCTGAAGAAAGGC<br>CACGGAAAGGTGGACGAGGCCATCCTGCACAATATCGCCTCCAGATACGGCAAGCAGTACACAAGCCCCCGAGGCC<br>AGAAAGAAGCCTGGACTGTCTGAAGGCTGA |
| | TniQ<br>(SEQ ID<br>NO: 1326) | CTGAAGTCCATCTTCCTGGAAGGCGAGAGCGCCATGAGCCACCTGGAAGAGAATGTGCCCAGACTGGGCTACGTGG<br>AACCCCCTGGAACACGAGAGCATCAGCCACTACCTGGGCAGCATGCGGAGATTCAAGGCCAACTCTCTGCCCAGCGC<br>CTACTCTCTGGGACAAGCCGCTGGAATTGGAGCCGTGACAGCCAGATGGGAGAAGCTGTACTTCAACCCCTTTCCA<br>ACTGCGCCGCCGAGCTGGAAGCCATCGAGACTGATCGGCCTGAACACCGACGACTGGAAGCTATGCTGCCCCCACA<br>GAGGCATGACCCTGCAGCCTAGACCTATCGACTGTGCGGCGCCTGCTACACCGAGTCTCCCTGTCACAGAATGGAA<br>ATGGCAGTACAAGGACGTGGTGGCCGTGTGTCCTCACCACTCTCTGAGACTGCTGGAAAGATGCCCCAGCTGCAAG<br>ACCCCCTTTCAAGATCCCTGCTCTGTGGACCGACGGCACCTGTGATCACTGCGCGCATGAGATTCACCAGCATGGTCAA<br>GTACCAAGAGCGGATCAAGAAAACCGGCTGA |

TABLE 27-continued

| Name/<br>Organism/<br>System<br>ID (T) | | Sequences |
|---|---|---|
| | Cas12k<br>(SEQ ID<br>NO: 1327) | ATGAGCATCATCACCATCCACTGCCGGCTGATCGCCAGCGAGCCTATTAGAAGGCATCTGTGGCAGCTGATGAGCA<br>GAAGCAACACCCCTCTGATCAACGACCTGCTGAAACAGGTGTCCCACCACGCCGACTTCGAGACATGGCAGTCTAG<br>AGGCACCGTGCCTAGCAACGCCATCAGAGATCTGTGCGAGCCCCTGAAAGAGGTGTACCCTGGACAGCCCGCCAGA<br>TTCTATGCCAGCGCCATCCTGATGGTCACCTACACCTACGAGTCTTGGCTGGCCCTGCAGCAGACCAGAAGAAGAA<br>GGCTGAACGGCAAGCAGCGGTGGCTGAACGTGGTCAAGTCTGATGCCGAACTGCTGGGCCTGAGCGGCAGCACACT<br>GGAATCCATTAGACAGAGAGCCCAGGACATCCTGAGCCAGCTGAACACCGAGATGGAAACCCAGTTCGCCCCATCT<br>CCTAAGAAGCGGAGCAAGCGGAGAGGCCAGACACACAGCAGCAATGACGCCAGCCTGATGAGCCGGCTGTTCACA<br>GCCCATGACACCGCCGATGACATCCTGTCTCAGTGCGCTATCGCCCATCTGCTGAAGAACGGCTGCAAGATCAGCG<br>AAACCGAGGAAGAGAGCGAGAAGTTCGCCCACCGGATCCACCGGAAGCAGAAAGAGATCGAGCAGCTGGAAGCCC<br>AGCTGCAGGCCAGACTTCCTAAGGGAAGAGATCTGACCGGCGACGTGTTCCTGGAAACCCTGGAAATCGCCACTCA<br>GCAGATCCCCGAGACAGTGATCCAGGCCAGAGAGTGGCAGGCCAAGCTGCTTGCTAGACCTGCCAGCCTGCCTTAT<br>CCTATCATCTACGGCAGCAGCACCGACGTGCGGTGGTCTAAGACCGCCAACGATAGAATCGCCGTGTCCTTCAACG<br>GCATCGACAAGTACCTGAAGGACGCCGATCCTGAGATCCAAGAGTGGTTCAAGCTGCACAAAGAATACCCCTTCCG<br>GGTGTTCTGCGACCAGAGACAGCTGCCCTTCTTCCAACGCTTCCTGGAAGATTGGCAGGCCTACCAGGCCAACAAG<br>GACACATATCCTGCCGGCCTGCTGACCCTGTCTAGCGCTACACTTGCTTGGAGAGAAGGCGAAGGCAAAGGCGAGC<br>CCTGGGAAGTGAATCACCTGGTGCTGCACTGCGCCTTCGACACCAGACTGATGTCTGCCGAAGGCACCCTCGAGATC<br>CAGCAAGAGAAGTCCACAAAGGCCCTGAAGAACCTGACACCGACAACCCCGATCCTCGGAACCAGAGCACCCTG<br>AACCGGCTGAAGAATGTGCCCGAGAGGCCTAGCAGAAAAGCCCTACCAGGGCAATCCCGAGATCCTCGTGGGACTGT<br>CTATCGGCCTGGCTGATCCAGTGACAGCCGCCGTGGTTAATGGCAGAACAGGCGAGGTGCTGACCTACAGAACCCC<br>TAGAACACTGCTGGGAGAGCACTACCATCTGCTCAACAGACACTGCCAGCAGCAGCAACAGAACGCCCTGCAGAGG<br>CACAGAAACCAGAAACGGGGCGTGACCTACCAGCCTAGCGAGTCTGAACTGGGCCAGTACGTGGACAGACTGCTG<br>GCCAACAGCATCATCCAGCTGGCCCAGACACATCAGGCCGGCTCTATCGTGATCCCCAGCCTGACACATCTGAGAG<br>AGCTGCTGGCCTCTGAGATCACAGCCAAGGCCGAGCGGAAGTCCAGAATCGTGGAAGTGCAGGATAAGTACGCCA<br>AAGAGTACCGGATCGCCATTCACTGA |
| | TracrRNA<br>(SEQ ID<br>NO: 1328) | TAATTTCCTCTCCTAAGCCATTTGAACCTAGATAATTTAATATAAAGTCTAACAGCGCCGCAGTTTAAGCTCTACAG<br>CCGCTGAACTGTGAAAAATGTGGGTCAGTTTGGTCGTTGCAAGACGATCGTGCTTTCCGACCCTAGTAACTGTCCGC<br>TCACTGACTGCCATCCTGGGACAAATCTTCAAATTTTGTGGATTTGTATGGGGATGGAAAGCTGCATTAGGCGATTC<br>TCTTTCTCTAATGTAGCGCAGGTGCGCACCCAGCAGAAGTGAGTCAAGCCTTCACAATGTGGAGGTACAGGAGCAT<br>CATCTCTCATTTTTTAGTGTAAATGGTGTGACTGAAGTGGTAGTTACCGAATCGCCCCTGATCAAGGGGGAACCCTC<br>CATAATTTTTTGGCAAACCGAAGCGAGGTTCAAAATCCTGGGAGGTTTGCCAAAGTCCAAAACCTTGCTGTTAGTGC<br>GACTTTCACAACTCTGGTAATCACTAAAGGGGTGTTTGTGATGCAGCTAAACAGCGGGTTTAAACAGGTTTGCCAAA<br>ACTTGACTTGGAAAGCTTGTAGGACAAGTATTCTAGCGCTGGGA |
| | DR<br>(SEQ ID<br>NO: 1329) | GTTGCGATCGCCCTCCCAGAGATGGGTGGGTTGAAAG |
| | sgRNA<br>(SEQ ID<br>NO: 1330) | TAATTTCCTCTCCTAAGCCATTTGAACCTAGATAATTTAATATAAAGTCTAACAGCGCCGCAGTTTAAGCTCTACAG<br>CCGCTGAACTGTGAAAAATGTGGGTCAGTTTGGTCGTTGCAAGACGATCGTGCTTTCCGACCCTAGTAACTGTCCGC<br>TCACTGACTGCCATCCTGGGACAAATCTTCAAATTTTGTGGATTTGTATGGGGATGGAAAGCTGCATTAGGCGATTC<br>TCTTTCTCTAATGTAGCGCAGGTGCGCACCCAGCAGAAGTGAGTCAAGCCTTCACAATGTGGAGGTACAGGAGCAT<br>CATCTCTCATTTTTTAGTGTAAATGGTGTGACTGAAGTGGTAGTTACCGAATCGCCCCTGATCAAGGGGGAACCCTC<br>CATAATTTTTTGGCAAACCGAAGCGAGGTTCAAAATCCTGGGAGGTTTGCCAAAGTCCAAAACCTTGCTGTTAGTGC<br>GACTTTCACAACTCTGGTAATCACTAAAGGGGTGTTTGTGATGCAGCTAAACAGCGGGTTTAAACAGGTTTGCCAAA<br>ACTTGACTTGGAAAGCTTGTAGGACAAGTATTCTAGCGCTGGGAGAAATCCCAGAGATGGGTGGGTTGAAAGNNNN<br>NNNNNNNNNNNNNNNNNNN |
| | LE<br>(SEQ ID<br>NO: 1331) | GAGCGTTACCTCGTTAAGGGTCGCTTGATCTGCTAATTCTCTCAGCGCTCGTGATTCTTGGCTATGAATTTGCTGATC<br>AGCGCAGATGATATGGGCCAGCAGCAAGAAGCCATAGTCTAATGCTGCACTAGATTGAGAAGATACAATAGCTACC<br>ATCTGGAGATTCTTGTTGAAGTCTTGATTTATCTAGCGAACTTCTCACAGGATGCCCGGATTTGACTCTAGTGCTTCA<br>CACAATCTCTATCTTTGTATTGCTTACCGAGAGCCGCTTCGCCTCTCCTCCATTACTGGCAAATTTCCTATCGTCATC<br>TAAACTATTTCAGAAGGAAAGTGGTATTTTTATACTATTCACTTTGAAGTGGCAGCAACCTTCTATGGACGAAAGCCA<br>AGTTGCCTGTTTAGATGCTGACCCACAAGACTTCGATGAAGTGGTGTTGAGCAGTCATGCCTTCGACACTGACCCAT<br>CCAAAATCCTGATAGACTCATCAGACCGTCACAAA |
| | RE<br>(SEQ ID<br>NO: 1332) | GTTGCAATCGCCCTCCCAAAAACGGATGGGCTGAAGCCATTTTTAATTCTTAAAGCTTTGGGGGGCTGAAAGGAGC<br>GCTGCAATGGCACTGTTAATTGCATTCAGTCATACTTAACAGTTGCGCCTGTAGCGACATTATTCTGCGAATTGTAA<br>AAGATTCGCCTTTTGCGACATTATTCTGCAAATTTCAGTAAGATACAGCAAAAAGTCCTTAAACGACATTAATTTG<br>CGAATTGCGACATTTAATGTGCGAACGTACAGAAAGAAATGGAGTTAAGCGGGTTCGAACCGCTGACCTCTGCAAT<br>GCCATTGCAGCGCTCTACCAACTGAGCTATAACCCCTCATTTCGTATTTTATCATGGCGCAATCCTAATCATTCAGTC<br>AAGCGGTCAACTTTGGTAAGCTGATAAACGTATCGCCCCTCAACAGAAAATGAGAGCCGTTTGAGACTTATGACTGA<br>GACACCCCAAGAGTTACCTAATTCTGATCTTGAGACAGGT |

Example 14—DR, Left and Right End Element Sequences, and PAM Sequences of Exemplary Cas-Associated Protease Systems DR, left and right end element sequences, and PAM sequences of exemplary Cas-associated protease systems are shown in Table 27 below.

TABLE 28

(SEQ ID NO: 804-827; where DR is SEQ ID NO: 804, Donor LE is SEQ ID NO: 805, and Donor RE is SEQ ID NO: 806, etc.)

| Orthologs (System ID (T)/ Ortholog name | DR | Donor LE | Donor RE | PAM |
|---|---|---|---|---|
| T21/ PGE M01000038 | GTTTCAA CACCCCT CCCAGCT AGAGGC GGGTTG AAAG | TGTCAGTATTGCCAAAATAATGTCCGCATTCA CTATGTAATCCAATTGTGTTAGCTAACCATTA ACAAAATAATATCGTTAAAAATATCGTTAAA CTTTTCAGCGTGGTGTGTTACTGTCATACATC AACCTTGCCAGCAAGACCTTACCCCCCTATG GGGATTTGTGGTTCAAAGAAATGAAAATTGC TGTAAGTTGACAAGTTT | TGTATTGTACTATGTAAAGGACATTTATTTTGT CAATTTTGGTAAAAATTTTGGCTGAAAACATTT TTCAGAAGAGGACAGTTATTTTGTCAATAGTTT AAAAGAGGACACTTATTTTGGCAAGAAGTCTC TAGTAGACTATTTTCAGACTAAAATAATAAAA CCCTTACTGAGTAAGGGTTTTAAGCTAAGTATT TTTAAGGACA | NGTN |
| T33/ AP014642 | GTTTCAT CCAGGTT TGCGGC AAGGGG GCGATT GAAAG | TTTAGGAGCGTTCTCAAATTTCACAACTCAAA TCGGATTGCTCTATGTGTAGATTGAAAGAAC AGCAAATTGCTAGCAGAATAAAGTGTTATTC GACAATTGTTGTCGAATAACACTTTAAATGTC GTCATAACGAATTGATGTCGTTCAGCCTCAAC AACTTAAACTTCCTATTAATATTGACTTTCAG CTCTTTCAGAGCGATCGCGCCCTTGCAGGAC GATTAACATTATCCATGTCGCTTTTCAGAGTA GTAACAAATTCAGTGTCGTGTTTTACGATCAG GGGTTTAACACAATCAGCGTCATGATTTTGA GATCTCAATAGATGACAACCAGCAAAAGGAC AACCTGACTTCAAAATCTACAATCAGACCAC AATCAAGGTGCGATCGCGGCAAGATTCCCAT AAACCTCAGTTTCCGCATAGTGTTTAGAAAA AATCTGCTTGAAAATCTATTTAGCTAGAAACC CAGAAATTCTAGCTAAATAAGAATTACT | GGTTTGCGGCAAGGGGGCGATTGAAGAGTAAC TTAGTCTTTTGACAACTTTAATAGGCACAATCT TTCGGTTAACAGTGGGTGGATTGAAAGGACTG CCTGACTCGGGGTTTTAATTTAGAAATATTTGC CCCTCGCTATAACGAGCAGAGTTAGCATTCGT TTTAACTGGGTAGAGTCTGTACTGTAAATGTT GAAGTGGATAAGAATTTGAATGAGCATTCAAC TGCTTGAAGCTCTGATGACAAGAATTTGTTAA CGAATGATTTCTTACCCCTCGACGACAAGAAG CTGTTAAAACGACACTAAATTGTTAACGACGA CATCAATCCGTTAACGACGACAAATAAAGTGT TATTCGACAACAATCACACGAATTTAAACAAA AAATTGCCTGACTCTTAAAAGCCCCCAGAGTC AGGCAGTCTACCTGTAAGGCACGCCTTTAACC GGATACACCAAACAAACTTAGTTGCCCCCTAG TTGCTTAGCTTTTCCGA | RGTR |
| T35/ AP017295 | GTTTCAA CACCCCT CCCGGA GTGGGG CGGGTT GAAAG | TTGATGGCTGAAAGCTAGGAAATACGTAAAT TATGCGTTTAGCACTGTCAAATGGACAATAA TTCTTTAAAACTGACAATAATTATTTAAAGTA CATATTGTACATTCGCACATTATATGTCGCAA TTTGCAAACAACGACATTAGACGACATTAGC ATCTTGAGCATCTAAAACGCTTATCGTATAAA GCTTTCAGGAAATTGTTAATTAAAAACGTTA AATTCCTGACTTCGCACATTGTATGTCGCTAA CATTAAAGCTCGCAAATTAATGTCGTTAATCT AAATTTTGTCACATTGCAAATTCAATGTCGCA TTTTCTTCAGTTAATGGTACATTAATACTACC AATAACTACATTCTCCTCGCTTAAATGCCAGA CAAAGAATTTGGATTAACCGGAGAATTGACA CAAATTACAGAAGCTATTTTCCTTAGTGAAA GTAATTTTGTGGTCGATCCATTACACATTATT CTGGAATCCTCAGATAGCCAGAAACT | CATCCCGGCTAGGGGTGGGTTGAAAGAGTAAG AAGAATAGAAGTAATTTCCTGAAATCAACTAT ATTTGGACATATTTTAGGAATATAACTAAATTA TGGGAGGGTTGAAAGGAGCGCTGCGATCAAAC AAATGTTAAGGTAAAATAATTCGTCTGTAGCA AATACCACAGTTAATGAGTAAGCCATACGACG TTAATTTGCGAAAAACTAATATGATTGAATTA ACGACGCGAATTAGCGAAAGTAATGTTAATTA CCTAAAAACGACATCAATTTGCGAAAAGCGAC AAATAATGTGCGAATGTACACATATGGAGAAT AGGGAACTCGAATCCCTGACCTCTGCGGTGCG ATCGCAGCGCTCTACCAACTGAGCTAATTCCC CTGACTTTGTTGAGTGTTCAGTTAATCACACTC GTCCATCATAGAGTATTTTAACATTCAGTTAGG GATGGCTGAGATTTGTTGCCAGAAAAAACTTC TTGTACTCGCTCTAGTT | VGTD |
| T46/ CP001701 | GTTTCAA CTACCAT CCCGACT AGGGGT GGGTTG AAAG | TCTCCTAAATTCGTTAACTTAATCTATATATC CTAACTTACTCAAAAGTCATTTAACTCCCCT AAAGTCTCCTCTCGCTGCGCTTCCAACTCCTG TACAGTGACACATTGTTTGTCATCGGTGACAG ATTAGTGTCGTCTTTTAAAGACCTTACTCAAT AAGGCTTACGTCCATTTTACACTCATTTGTAC TATTTTTGTTTGGTGACAAAATAAGTGTCGCT TTTTGCTTTTATGACAAATTAATTGTCGTTTTT TCATAAAGCTTCAAAAATAATTGTGACAAAT TCCATGTCACTTTTTCTATAAATGTCTGCTAA AATAACATTATGGTTTTTAAAATAGTGTTCTA ATTATGAGATGAATACTTTTCCTAATGAGCAG TCTAATGCAATTGTACTAAAAAATACCATTGT ATCGGATTTGCCAGAAACGGCACGGGCTAAA ATGGAGGTCATCCAGACACTTCTAGAACCCT GCGATCGCACAACTTACGGAGA | GTTTCAACGACCATTCCCAACAGGGGTGGGTG AAATATAGTCTCAATATTTTCAATGTTAAGATG GATTGAAAGGCGCACTTCGTTCGGGAACATAC TATCGAAGTATTAAAGATAAATGCCAATGCTC AGATCATGACAATTAATTTGTCACCAGTGCTTA AACGACAGCAATTTGTCACAAAGACAGTTAAT TTGTCTCCACGACACTAATCTGTCACCGATGAC AAATAATATGTCACTGTACAAATCGGGATGAC AGGATTTGAACCTGCGGCCCCTTCGTCCCGAA CGAAGTGCGCTACCAAGCTGCGCTACATCCCG TAAAATTAAACAGCATTTCTATTATAGCACGA TCGCCCCTAAGACTCTATCCCCTCGCAAACTTT AATGAACTGCCGATCAAGAGCCCCTACCCAGA ATGATAAGCTAACAGATGGACTAAAATTCGTC AGTAAGCTACTATGACTCAAGGTAATAATACC CCCTATTTACTCCGTG | RGTR |

TABLE 28-continued (SEQ ID NO: 804-827; where DR is SEQ ID NO: 804, Donor LE is SEQ ID NO: 805, and
Donor RE is SEQ ID NO: 806, etc.)

| Orthologs (System ID (T)/ Ortholog name | DR | Donor LE | Donor RE | PAM |
|---|---|---|---|---|
| T47/ CP003610 | GTTTCAA CTACCAT CCCAACT AGGGGT GGGTTG AAAG | AATTGCAGTGGGATGAGAGGGTTCTAGATAG CTGATAGGAGTTACAGGATACCACTGTTTAG TCCAGGAAAAGTTAGTCATCATCAAATTAAC TAATTTATTCGACTCAAATTTGAAAAATGAGT AAAAAGCGGCATTTAATGTGCGAATGTTGTA CATTCGCACATTATATGTCGCTTTTCGCAAGT TAGGTCGCAACCGCATTTAACTGCTATAAAC CCTATTTTACAAAGGTTTGATGCTCTTAGCAC ATCAAGCCCACGAATTTACTTAATTCGCATAT TCCATGTCGCAAACTAAATATTCGCAAATTG AATGTCGTTTATTAAAATTTGTCACTTCGCAA ATTGTTTGTCGTATTATTGAGCGATTCATGGT ACATTGGTACTCTAATGAGTGTTTTTGCTCTA ATGGCAGACAAAAAATTTGAATTGACAGAAA AATTTACACAACTTCCTGAAGCTGTTTTTCTT GGCGAGAATAATTTCGTAATAGATCCA | ATCAGACTCTTAATTTAAGTGATAGAGATAAT ATTTAAGCACAGATATATTTCTTACTCAGCAAT AGCATTTAGTATTTGCATGGAAATAAATAGCT TTGAGACAACATTAATTTGTTAACGATGTCTTT GAGGATTTAGGGGACATCAATTTGTTAAAAAA GACATTAATTTTGTTAACGACGACAAATTATTT GTAATCGACTTTAGGACAAATAATTTGTCGCTT TATGTACTTTGACAAATAATGTGTCGCTCTACA TCAGTTAATCGACAATAACCAAGCGACGTTAA TTTGCGAAAACCTATAATCATCAATATAGTAC ACAAATCTGTCGAAAGCGACACTAATTTGCTA ATAACGACACTAATGTGCGAAAAGCGACATTT AATGTGCGAAAGTACAAATGTACAAAATGGGC GACCTGGGGCTCGAACCCAGAACCAGCAGATT AAGAGTCTGATGCTCTACCATTGAGCTAGTCG CCCTCACCATTTACT | NGTN |
| T56/ AP018288 | GTTTCAA CAACCA TCCCGGC TAGGGG TGGGTTG AAAG | TAGCTGAAAGTTAGGGAAATACGTAAATTAT GTCGTTTAGCACTGTCAAATTGGACAATAATT CTTTAAAACTGACAATAATGATTTAATGGAC ATGTCGATTAACTAATTATTTGTCGTCTTAAC AAAATAATGTCGTCAAAGATAAAATGTTTGA AAACGTTGCTAAATAAGTGTTTGCAGCGTTTT TTAGTATGTCAACAATCAAGACCGAATTTAA CATTTTAATTGTCGTATATTAAAATATTCACA AATTTTATGTCGTTTTTTCAGATTTGAGTTTTC CAAATTTTTTGGAATGTATAACAAATTAGTTG TCGTTTTTAGCAAAAATAGTGCTATTATAAT ATTATTTAGTATATATGTACTAAATAATACAT TCTCATACCAAAAAGTTACTACTTCCATTGAC GGGTCAACCGCTTTAGGAAGATTGGATGTTA GCGCACAATAGCGAGTTTGATATTACTGTTTT GAGCATGAATCAAGTTTTCCTATG | GTTTCAACAACCATTTAAGCTAAGCAGGTGTT GCAAAAATAAGTATATAGAGACTATTTACTTG CACTAACTAGGCTTTAGAATTGTTGAAGGGTA TAACTGAGTTATTAGGAGGGTTGAAAGGAGCG CTGCGATCGAACAAAAATCAAAGTCAGTGGTT AAGCATAATCAACAATTCAATGACATTAATGT GTTAACAGTTGACTAAGTTAAATCGATGACAT TAATTTGTTAAAAGCGACGCTAATTTGTTAATA ACGACAATAATCTGTTAACAACGACAAATAAT TAGTTAATCGACAGGACATATGGAGAATAGGG AACTCGAATCCCTGACCTCTGCGGTGCGATCG CAGCGCTCTACCAGCTGAGCTAATTCCCCTTAA AAGTGCTGAGTCTTGCTAACTAACGCACTAC TACAATATAATATTTTAACATTCTCCTGCTGTA GGCTGAGACTCTTTTTGTAAAAAGACTTCTTGT ACTCGTTCAAGTTCTA | VGTR |
| T63/ KV878783.1 | GTTTCAA TGACCAT CCCACGT TGGGAT GGATTG AAAG | TTGGCGTGGTCGATCAGTTCTGAACTGTCTGC CCCCACACTGCCCCCAAAATCTTGATTTTAAT GACATTTTTTTTCCAATTTTAGGGTGTGGGTG TCGATTGACTCATTAACTGACATCTTGACAAA TTATTTGTCATTGCTATAGACAAGCCTGCAAC CCTTACTATACATAAGGTGTGGGCTTTTTGC ATTGGAAATTTACTCAAAAGCAAAATTGACA AATTAGGTGTCGTATATTAGGAGTTTGCCAA AATATGTGTCGCTTTTCATTTAGTCCAGATTT TCTGGCTTTTTGACACATTCTGTGTCGCTCAG GGTAAAATAACAACATGTTTGTATTAAACAC ATTTGTTGTAAATGAATACAGGTAATCAAGA AGCTCATGCAGTTATCACTGACTTCTCTGAGG AGGAGAGGTTAAAACTAGAAGTTATCCAGAG TTTGATGGAACCCTGTGATCACGCTACCTATG GACAAAAGTTAAAAGATGCGGCTCA | GTTGCTGAAACCATCCCAAGGTGGGATTAGGT TGAAAGAGTAATACAAGAATTGGGTTGGATTGA AAGCAAGTCCCACCGTCCCCTACTTTAGTGCA ATGCAAGATTACACAACAAACTTGCTCTGAAT GTATGGAAGGTTCGTAAAAGTGGTGACAAATA ATTTGTCAAGATGACATCAATTTGACAACGAT GACAAATAATTAGTCAATCGACATGTGGGCAA CACCGTCAGAACAACTCAGAAAACTCTGAAAC GATGGGGGTGGTGGGACTTGAACCCACACGTC TTTTTACGGACAACGGATTTTAAGTCCGCAGC GTCTACCATTCCGCCACACCCCCAAGAGCAGT GACAGGGTTCTAGTTTAGCAGCAAATGGCGGC CACTGCATGGAACAGAACCCTCAGAAAATCTA ATCAATCTGCCTCTTGCGCTCCGATGGGTTGAA TTGTTTATGATGGGAGGGCGTTTGCTACTGCGT TGGTGACTGCCAATATCG | NGTN |
| T69/ KV757663.1 | GTTTCCA AAGCCC TCTCGTT AGGTGG TGGGTTG AAAG | TACCTTCTGGACATTGCCCACATCTGTCTCGT CCTGACCTTCTTGCCTCAATATTAACTAGTAA TTAATTTTTTGATCCATATTTTAGGAAATTAA CCGAAGCGTATTGAGTGTGAACAAGGGAATA TCTTTGAAATTTTAATTCGGCATAGACGAACG ATATTATCTAATTAATAACGACATGAATTTGC AAATTGCGACATTGAATTTGCGAATGTACAC ATGGTGTCCATTAAATAATTATTGTCACTTTT AAAGAATTATTGTCCAGTTTTACGATATCTGT ATAACAGGCTCAAAGGCTTACCAAACAAGTC TTTGAGCTATATTTATACTTTTATTATTCTCTA GCCAGTTTTAAGTAAATGATGTCATTTTTCT GATAAATTTTTAAAGTAAATGATGTCATTTTT CTTGAAGACGGGTCAAGTGTATGTCTACGC GTTCTTTGAGTCAAGGCGCTAATCTCCCCGGT CATGAGGAAGTTCTTGCAACGGA | GCATATAGGGTGATAAATCCAAACCAATAACT TCCGCTTGCCAGAAAGCCTGTTTTAACATTAAA GTTGTGGAACCTGTGCCGCAACCTAAATCAAG TATGCGTCGTGGTTTCACCTTGACGGCATCAAC TAAAGCTTGACGGACAATACTTTCATTCGGTG GCAGAACATATTGGGTAATCGGATCGTAAGTA ACTGCTGCACTGGAATTGAGATATCCGCCTGT AACACCATGAAAATTTTGACTACTGTAGTACG CCGGAATTATCACATCATCTCGTTGGAAGCGA TCGCTCTCTTTCTCCCAGTCAATACTATCAGCG TAACGCCGTAACCCGTCTTCATCAATCAAAAG ACGCACTACAGGGGATAAAAACGTTCCCAGA TTGTATCTTGACGCACTACCATATTGTGTCAGA ACTTTAAAGTTTACTTAAGTAAAGTAATTTTC TTTACAAATTTTAATACATTTATGAGACATCTG CTTTCTGTCTGTGGTATTGGCTTGACGCTTGTA ATTATTTTAGTTACACTTGTAATACAAAGAAGC TACTCTCTAAAAGTAGTTCTTCAGCTTCACGAA AATTGAGCGAACAAAATGAAAGACAATATAA | NGTN |

TABLE 28-continued (SEQ ID NO: 804-827; where DR is SEQ ID NO: 804, Donor LE is SEQ ID NO: 805, and Donor RE is SEQ ID NO: 806, etc.)

| Orthologs (System ID (T)/ Ortholog name | DR | Donor LE | Donor RE | PAM |
|---|---|---|---|---|
| | | | CATTTAAATTGCTACAACTAACTAGTAGTATGT CAATTTGAAATCAATGCCTTACAACAAACCTA CAGAACTTATTTCAAAAACCAAATACTAGTCA TATCGATAATAAGTTATAAGTCATATCGATACT TATCAGTGACATCCTCACCTACCTAAAGGCGC GGTGATTCTGGAGTAATGAGTAATAAGTAATG AGTAAATACCCATTTTTCATCCACTCATTACTC ATTACTCCTTACTCATTACTCATTACTTTAAAG CATTGTGTGAAGCACAGGGCTTCAGATCCAAA TATGTGGTGACATCGACCCAATCGAAAATCTA AAATTCAAAATCCAAAATAGAAACAATTATGC CATACGAAAAGTTAGAAATTACCACACC | |

Example 15—Exploring CAST Systems Functional in Mammalian Cells

Cas12k, TniQ, TnsB, and TnsC with NLS tags on N- and/or C-termini were transfected in 293 cells and insertions were detected by PCR. Rapid testing was performed using PureExpress. 293T cells were transfected with CAST components, sgRNA, donor (linear or circular), and a target plasmid. No insertion was detected by PCR under this condition (FIG. 62).

TniQ and Cas12k were poorly expressed. The msGFP fusions were used to increase expression/stability. Human cell lysate for each component had detectable activity in vitro, but not all together (FIG. 63). Cas12k lysate with purified TnsB/C/TniQ were tested.

An exemplary wildtype ShCAST that showed preference of certain concentrations of magnesium at various temperatures (FIG. 64).

Bioinformatic analysis was used to explore CAST systems that may be functional in mammalian cells. 149 candidate loci were identified by Guihem (NCBI Prokaryotic database and JGI metagenomes). The candidates were narrowed down to 41 systems with all components and detectable LE/RE elements (FIG. 65). Applicants synthesized as human codon-optimized bacterial pHelper plasmids.

Donor ends were predicted (FIGS. 53B, 53C, and 66). The identified CAST were tested for general NGTN PAM preference and insertions downstream of protospacer (FIG. 67). Some CAST systems exhibited bidirectional insertions (FIG. 68). New sgRNAs were also predicted (FIG. 69).

15 new functional systems were identified using various assays (FIG. 70). Bacterial assays were performed to confirm sgRNA activity. Mammalian expression assays were performed for in vitro testing with lysate, optimizing NLS tags (TnsC), and plasmid/genome targeting. Biochemical characterization was performed for purifying all CAST systems (35/72), determining $Mg^{2+}$ and temperature preference, and RNP delivery into cells. The assays were used for screening systems for hyperactive variants (FIG. 71). Putative hits and troubleshooting CAST (Cas12k in particular) was toxic to cells. The insertion products were evaluated using genetic assay for cointegration and nanopore sequencing (FIGS. 45A-45C, and 72).

Example 16

Exemplary Cas-associated transposase systems, including DNA and protein sequences of TnsB, TnsC, TniQ, and Cas12k, are shown in Table 28 below.

TABLE 29

| Locus | | | Sequences |
|---|---|---|---|
| Ga0334928_0000020 | TbsB | DNA (SEQ ID NO: 828) | ATGACGGCAGATAACCATGATGCCTCTGCAATTGTGACCGAACTTTCGCATGAGGCAAAACTGAA<br>GCTAGACATTATTGAGAGTTTGCTGCAAATCAGTCAGAAGCCGATCGCCAACTTACGGGCAACGACTTAAAG<br>AAGCTGCCAATAAACTTGGCAAATCAGTAAGAACGGTGCAGAACCGATTGGTAGAAAGTGGGAAGC<br>AGAAGGTTTACTAGCCTTAACTGGCACAGAGAGGCACAAGAAGCAAGCATCCGCATTTCTCAA<br>AAGTGGCAAGACTTTTATTATCAAAACCTACCCGTGAGGGGAATAAGTGTAGTAAGCGGATGTCCCG<br>CAAGCAGGTTGCTTTAAGGGTTGAAGTTAGAGCTCAAACCCTTGATTGAAGCTGAAGCCAAGAGGAGAGAAGAAGGGGTTCGT<br>ACCGCACAGTTTATCGAGTATTACAACCTTTAAACTCCGGAACCCGGAAAAAGAAAGGGTTCGT<br>AGTCCAGGGTGGCGAGGTTCACACTTACGACTATCGGTTAAAACCGGACGAGAATATTTCAGTGGA<br>GTACAGCAACCATGTGTGCGCCCCTGGTTAACGACAGTAATTGATACATACCACGCTGCATTATGGGT<br>GGGTAATTATCGGTCGCCCCTGGTTAACGACAGTAATTGATACATACCACGCTGCATTATGGGT<br>ATTCCGTGGGGTTTGATGCACCGAGCTGAGGTAGTAGCGTTGCCGTTGCCGTCATGCAATGCT<br>ACCCAAAAACTATGGCGTCAGTATGGGTTCATTGTCAGTGGACTATGCGCAACCAGAA<br>TATTTATTTACAGATGGCGCAAAGATTTTCGCTCAGAACACTTAAAGCAAATTGCGTACAGTT<br>AGGTTTAGTTGTATTCTACGCGATCGCCCCTAGTGAAGGTGGTGTGGTGAGCGCCGTTGGGAC<br>TTTGAATACAGAGTTATTGCAGGATTTCCTGGATATGTTGGCTCAAATGTCCAACAACGTCCAGA<br>ACAAGCGGAAAAGGAAGCGTGTTTAACTTTACGGAACATGAAACGCAGATTGTTCGCTACATC<br>GTAGATAACTATAATCAACGAATTGATAAGCGCATGGGAGATCAGAATTTGAAATTGATGTATCAGCGTTGGA<br>AGCAGGTTTATTAGCCACCAGATTTAATTGTGAGCGAGATTTAGATATTCGCTTTGATGAAGC<br>AAACCAATCGCTCAATTTACCGAGAGGGTTATATCCGCTTTGAAATTGATGTATCAAGGAGAG<br>CATTTAGCCGGATATGCAGGGGAACCGGTGGTTTTGCGCTAACGACCCTAGAGACATTACCAGCGT<br>GCTGGTTTATCAACGCAAAAAGATAAAGAAGTTAAGGCAAGTAATAACGCCCAGTACCTAAAAGAAACCAAG<br>AGAGAACAAGTATCGCTAGAAGTTTGGAAGAAGTAAGAGACAGAATATTTTGTTGCCAAGAAG<br>AAGACCAAGAAAGAAGCAAAGCGGAACCGGTGGTTTAACTTCTGCTGTCCCGAAATCA<br>AGCCCTTTGAGGTTGAACCAGAACCAGAGATTGAAGATACGCCAGTACCTAAAAGAAACCAAG<br>GGTATTGAATTATGACCAGTTAAAAGAGAGATTATGGGTGTAA |
| | | Protein (SEQ ID NO: 829) | MTADNHDASAIVTELSHEAKLKLDIIESLLEPCDRQTYQRLKEAANKLGKSVRTVQRLVEKWEAEG<br>LLALTGTERADKGKHRISQKWQDFIIKTYREGNKCCSKRMSRKQVALRVEVRAKELGEEDYPNYRTVY<br>RVLQPLIEAQEQKKGVRSPGWRGSHLSVKTRTGENISVEYSNHVWQCDHTWDVLVVDIEGVIIGRP<br>WLTTVIDTYSRCIMGIRVGPDAPSAEVVALALRHAMLPKNYGAEYGLHCQWGTYGKPEYLFTDGGK<br>DFRSEHLKQIGVQLGFSCILRDRPSEGGVVERPFGTLNTELFAGFPPGYVGSNVQQRPEQAEKRACLTLR<br>ELEKRIVRYIVDNYNQRIDKRMGDQMRYQRWEAGLLATPDLIGERDLDICLMKQTNRSIYREGYIRFE<br>NLMYQGEHLAGYAGERVVLRYDPRDITSVLVYQRQKDKEIFLAGANATGLETEQVSLEEVKASNKK<br>VREKGKTISNHSILEEVRDRDIFVAKKKTKKEROKEEQKLHSAVPKSKPFEVEPEPEIEDTPVPKKKP<br>RVLNYDQLKEDYGW |
| | TbsC | DNA (SEQ ID NO: 830) | ATGGCAGAAAATAAATTCAATCTGTTGCCGAACAGTTAGGAGAAATCAAGTCTTTAGATGGCAA<br>ATTACAAGCGGAATCGTTGACCAGTTAAGACAGAAAAATAATTGTGAGGTTGGAGGAGAAATGTGAGCAGGTTAGCGAC<br>CTCCATAATTGGTTAGAAGGCGGCCATGCGCTCATTCTTGTAAAATTGCTCGGGATTGCCG<br>GACAGGAAAAACTGTAGCTGTGATTCTTAGACACAGAGAATGCAGCAATGCAGACACATCAAGAAGTAGGA<br>AAACCGCCAACTGTACCTGTCGTGTATATTCAACCTCCCAAGAATGCAGTTCAAGAGAGTTATTT<br>CGGGTGATTATTGAGCATCTGAAATACAAGGGTAAAGCGAACGGTGGGGAAATCCCAGTA<br>GGAACCTACAGGTTCTTAAACGCTGCAATGTAGACGTGGGATATTTGATTATTGGGTATTCTGTAGTCCTTAGTA<br>AAGCCCAAAACTTTGCGGATGTACGGGGATATTTGACAATTTGACAATTGGATTGGGAACCAGATA<br>TTATCCTTTTACCGGATACCCGAATTCTGTAGTTAAGCAACCATGGTAACCTGGGAAGCAA<br>CAGGCGGTTACATTGGTTGATGATGATCATTGTCCTGAAGCGGGATTTAAGATCCTGGGAGAAGCAA<br>MAENKSQSVAEQLGEIKSLDGKLQAEIDRLREKIIVELLEQVSDLHNWLEGKRRSRHSCKIVGDSRTGK |

TABLE 29-continued

| Locus | | Sequences |
|---|---|---|
| TniQ | DNA (SEQ ID NO: 832) | TVACDSYRLRHRPIQEVGKPPTVPVVYIQPPQECSSRELFRVIIEHLKYKMVKGTVGEIRSRTLQVLKR CNVEMLIIDEADRLKPKTFADVRDIFDNLGISVVLVGTDRLNTVIKRDEQVYNRFRPSYPFGRLQGNKF KETVEIWEQDILRLPVPSNLGSKPMLKIIGEATGYIGLMDMILREAGIRALEKGLTKIDRETLEEVAQ EYK ATGGATCAGATTCAACCCTGTTGTTTACGATCGCACCACTAGAAGGAGAAGTTAAGTCATTT TCTAGGACGTTTTCCGGCGGAGAAATGATTTATCGGCTTCAGGGTTAGGAAAAAGAGGCGGAATTG GTGCTGTTGTAGCACGATGGGAAAAGTTCTATCTACCGTTTCCTCCGCTTAGAGAGTTGGAAG CATTGGCTAAGGTGGTTCAGGTGGATAGCGATCGCTTGCGGGAGAGTTACCACCTGAAGGGGTG GGGATGAAGCAGCACCAATTCGCCTCTGTGGGCGCTCTGGTTATGCCAGATGCCCTGTCACAGAT TAAATGGCAGTTTAAGAAGCACGGAGGATGCGATCGCCACCAGCTAAGTTTACTTTCAGAATGCC CTAACTGTGAGCAAGGTTTAAAATTCCGGCTTATGCCCAGATGGATGGTGTCAGCGTTGTTTTA CAACTTTGCAGAAATGCAAAAGGTCAAAAGGGTCAAAGAACAGTCTGTGA |
| | Protein (SEQ ID NO: 833) | MDQIQPWLFTIAPLGESLSHFLGRFRRENDLSASGLGKEAGIGAVVARWEKFYLNPFPSLRELEALAK VVQVDSDRLREMLPPEGVGMKHEPIRLCGACYAESPCHKIKWQFKKTQGCDRHQLSLLSECPNCGAR FKIPALWADGWCQRCFTTFAEMGKMQKGQRNSL |
| Cas12k | DNA (SEQ ID NO: 834) | ATGAGCCAGATAACTGTTCAGTGTCGTTTGGTTGCAAGTGAATCAACTCGCCATCATCTCGAA ACTGATGGCAGACCTGCCCTTAATTACGAATTACTGGCGCAAATGCTCAACATCAAG ACTTTGAAACCTGGAGGAAAAAGGCAAGCTTCCCGCTGGAATAGTCAAACAGCTATGCCAACC TCTTAAAACTGACCCTCGCTTCACTAAATCTGGTTTAAAATTCAGCAACGCCTAGAACAAACCTAGAAGGGCAAA TTCGTTGGCTAGAAATGCTCAAAGTGATGAAGAATTAGCTGCCAAAGTAACACATCTATAGAA GTAATTCGCACTAACGCCCCCGCCTACTTATTCTCCTATCCTCTGAAGAGGATTCGAAGATGAG AGTGTTTTACCAGACTTTGGAAAGCATACAACGGCACAGACATCCTTACTCGCTGTGTTATC TGCTACTTACTGAAAATGTAGTAAAGTCCAAAAAAACCTGAAGAAACTTAGAAAGTTGC TAAACGCCTCGCAAAGTTGAAATTAAGATTGAACGCTTAAACGAACGAAACTAGAAAGTCGCATTC CAAAAGGTCAAATTTAACAGGAGAAAACTGGTTAGAAACATTAGCGTCATCACCTGCC CCCGCAGATGAATCAGAACTAAACCTGGCAAGATAAACACACTGCTAACTGATCAAAACTGTTCC TTTCCCGTAGCCTACGAGATCTAACGAAGATTTAACTTGGAGTAAAAGCGAAAAGGTCGTCTTT GCGTTCAATTTAATGCTTAAGCAAGCAGATAATTCCAAATCTATTGCCAACCCCAACGCCACTTAAAT GGTTCAACGCTTTCAGGAGATCAAGAATCAAAAAAGCTAGTAAAAATGACTAGTATTCTAGTGT CTTTTCACCCTGCCTCAGGAAGAAGAATTCTTGCCAAGAAGGCACAGATAAGGTGAACCTTGAA TATTCATCACCTCATCCTTACTGCACCGTAGACACCCGTTTATGGACGCGAAGGTACAGAAC AAGTTGCCAGGAAAAGCACAAGCTTTATTTGCCGTAACCAGTCAACCCTAGCCCGACTTAAAAACC TCTCCATGACAAAACAGCAACCTTCCTATCAAAGTCAGCCTTATTCTTGTAGGTGTAGCATTAG CTTTTCCCGTGCAACCTGCTACCGCAGCAGTTATTGATGGGATAACAGGTAAGCGATCGCTTACCGT GACTGGATAAACCTGCTACCGCAGCAGTTATTGATGGGATAACAGGTAAGCGATCGCTTACCGT AGTGTCAAACAACTACTTGGAGATAAATACGAACTGCTAAATAAGCAGCGCCAGCGTAAACAC GGCAATCTCATCAACGCCACAAAGCTCAACGCAATGGCAAGAACTAATCAATTTGGAGATGCTAA ATTAGGTGAATATGTTTTACCGAAACTAGGCGATATGCGTGAAGACAGGAAAAATATGCCAAGCTATTGT CACCCTTGCTCCAAGCCCATCACCG AGCTAGTATGTTTTACCGAAACTAGGCGATATGCGTGAAGACAGGAAAAATATGCCAAGCCGTAAATCCA GAGCAGAGCAAAAATTCCAGGTTATATCGAAGGACAGAACAATATTAAAGCTCAAGCCGTAAATTAA TAGCGTTCATCAATGGAGCTATGCGAACTCATTGACAGCTACATATATAAAGCTCAAGCTGCCAAATTAA GTATTGTCGTTGAAGAAGCAAACCCATTCGTGGTAGTCTGTGGAAGCTAA GCAATTTCTGCCTATGGCGATCGCTCTAAATCTGAAGCTAA |
| | Protein (SEQ ID NO: 835) | MSQITVQCRIVASESTRHHLWKLMADLNTPLINELLAQMAQHQDFETWRKKGKLPAGIVKQLCQPL KTDPRFTNQPARFYTSAITLVDYIYKSWFKIQQRLEQNLKGQIRWLEMLKSDEELAAESNTSIEVIRTN AALLITSLSSEEDSEDESVSTRLWKAYNGTDDILTRCVICYLLKNGSKVPKKPENLEKFAKRRKVEI KIERLKRQLESRIPKGRNLTGENWLETLAIASTTAPADESEAKSWQDTLLTESKLVPPVAYETNEDLT WSKSEKGRLCVQFNGLSKHIFQIYCDQRQLKWFQRFQEDQEIKKASKNEYSSGLFTLRSGRIAWQEGT DKGEPWNIHHLILYCTVDIRLWTAEGTEQVCQEKAEDIAKILTNMNKKGDLHDKQQAFICRKQSTLA RLKNPFPRPSQPLYGQPYLVGVALGLDKPATAAVIDGTGKAIAYRSVKQLLGDKYELLNKQRQRK |

TABLE 29-continued

| Locus | | Sequences |
|---|---|---|
| Ga0334957_0000173 | | QRQSHQRHKAQSNGRTNQFGDAKLGEYVDRLLAKAIVTLAQAHHAASIVLPKLGDMRELVQSEIQSR AEQKIPGYIEGQEKYAKPYRVSVHQMSYGRLIDNIKAQAAKLSIVEEAKQPIRGSPQEKAKEIAISAY GDRSKSGS |
| | DNA (SEQ ID NO: 836) | ATGTCTAATGCTCATCCCTCAGAAACGATTCCAGATGAGGGGCAACCTCGAAGAAGCCAATAC CATCCCCTCTGAGTTTTCCGACGAGCGAAGCTCAAGATGCAAGTTGAAGTGATTCAAAGCTTATGGAGG CGGGCGATCGCGCCACGTATGCCGTTAGTGGATAAATGGAAGAACAAGGCTGCTCAAAACTGGGCAAGTCGGT GAACGCTCTGATAAAGGTAAGCACCGAGTTGATCTGCAAGATTTAATTCTCACAACCTA TCGGGAAGGAAATAAGGGCAGTAAACGATGAACCCCGAAGCAGCAGGTTTCCTAAGAGTACAAGCA AAAGCTCACGATTAGGGGTCAAGCTCCCAGCCACATGCCAGTCCGGATGGCGAGGATGCGTTTGTCG AATTGAAAAACTCGCGACGCGTGCAGATTTGGCAGTGCAACCAGTGTGCAATGCGATC GTTAAAACTCGCGACGCGTGCAGATTTGGCAGTGCAACCAGTGTGCAATGCGATC ACACTCGCGCTGATCTGTTCCTAGTGGATCAGCATGGGGAAATTTTAGTCTGTCCTTGGTTGACCA CGGTTATTGATACCTATTCTCGCTGCCATGCTATTTTGCGAAGCAATACGGTCAGAATATGGTCTCA GGTAGTGCCTTAGCTTTGCAGCATTATGGGAAGCCAGAGCATTTATACTGGATGGGGAGGATTTTGTT TGCCAGTGGGAACTTATGGGAACCAGAGACTTTGGGTTTTATATACCAGCAATACGGTCAGAATATGGTCTCA CGGAACATTTGCAGCAAATAGGAGTGCAGTTAGGGTTTGTTGCCATTTGCGCATCGCCCTCTG AAGTGGTATTTGTGCGAGCGTCCCTTGCGACATTGAACACCGAGCTATTTTCCACTTTGACTCTCG ATACGGGTCAAATGTACAAAAGCCGGCCAGTACGTCGCGCTATTTGTGATAACTACAAGCGACTCCGAT GCAGTTAGCGAGCAGCATTTAGTCCGCTATCTGTTGATAACAGCTCTGACGCTCGGAT GCGATATGACCCCAAAGATATTACCAAGGCTTTTGGTTTACCGCAATGAGGGTAGTAAGGAGGTAT GGGCACCAAAGAAGTTTCAACGATGGGAAGCCGCGATCCGCCATATGCGGCTGGTGACGGGGAGTAAG AAAAGATTTGGATTTGAAAACTTTATGTATCGGGGAATATTTGGCCGGTTACGCAGGGAAGTGTAGTGCT GCGATAGACCCCAAAGATATTAGTCCGCTATCTGTTGATAACTACAAGCGACTCCGAT TTTTAGCCCCGTGCAGTAGCACAAGATTTAGAAGCTGAAGACTATCTTTAGATGAGGCGAAAGT AGCAGCCGCAAGGTTCGGGAAGCTTGGGAAGCCGGTTAGTAACAGTCGCGCAAGAAGGTGACAAGG GCGATCGGCACACTTCGTCACTCAGAAGAACAAGAAAGAACCCAAAGCTGAACAAGG TGAAATCCGTAAGGCAAAACAGCCTGTATCTATGGAACAGAATAAAGCCGGAAGTGTATCGAAC AACGTGAAGCTGAACCAGAATGCGAAGTATTGATTACGAACAAATCGCGCAAGATTACG GGTGGTAA |
| | Protein (SEQ ID NO: 837) | MSNAHPSETIPDERGNLEEANTIASEFSDEAKLKIEVIQSLMEAGDRATYAQKLKEAAQKLGKSVRTV RRLVDKWEBQGLSGLVETERSDKGKHRVDTDWQDLILTTYREGNKGSKRMTPKQVFLRVQAKAHEL GVKSPSHMTVYRILNPLIEKQEKAKSIRSPGWRGSRLSVKTRDGADLAVEYSNQVWQCDHTRADLLL VDQHGEILGRPWLTTVIDTYSRCILGINLGFDAPSSQVVALALRHAILPKQYGAEYGLHCQWGTYGKP EHFYTDGGKDFRSEHLQQIGVQLGFVCHLRDRPSEGGIVERPFGTLNTELFSTLPGYTGSNVQKRPEDA EKEACLTLRQLEQHIVRYLVDNYNQRLDARMGDQTRFQRWEAGLLAMPLISERDLDICLMKQSRRI IQRGYLQFENFMYRGEYLAGYAGBSVVLRYDPFKDITRLLVYRNEGSKEVFLARAVAQDLEAEELSL DEAKASSRKVREAGKAVSNRSILDEVRDRDTFVTQKKTKKERQKAEQGEIRKAKQPVSMEPEPEVV SNNSEAEPEMPEVLDYEQMREDYGW |
| | DNA (SEQ ID NO: 838) | ATGACGAATCAAGAAGCCCAAGCAGTCGCCAAGGAATTCGCGATATTCCGCTTAATCAAGAA AAATTCAAGCGGAAATTCAAGAGATCTGAACCGCAAGACTTTTGTCGACAGTTTGGAACAGGTGAAAATT CTCCATGACTGGCTGGAAGGAAAAGCGACAGTCTCGGCAGTCTACGGCGAGTTGTCGGCGAGTCGA GGACGGCAAAACTATGGGTGTGATGCTTACATCCAAATTCCGCAAGAAGTGTGGCGCAAGGAATTGT TTGGGGTGCTCTTGAGCATTTGAAGTATCAGGTGGTTAAGGGAACGAATCGCCCGAAATTCGCGAT CGCACGATGCGGGTGCTCTCAAGGGTTGCTGCGCGATATTTTGATAGGTTGGAAATTCCGGTGATTTTGT TAAACCTAAGACGGTTGCTGAGGTCGGTGATGGCGCCGATAATTTTGATAGGTTGGAAATTCCGGTGATTTTGT AGGAACCGGATCGCTTGAGATGCGGTAAGTTCGGGTGATGAACAGGTTTATAACCGTTTCGGTCAA GTCAACGGTTTTGCGTTTCCGGACGAGAGTTTAAGCGACCGATGTTGAAGACTTTGGGAAAGAG GGTTTTGCTGTTACCTGTGCTTCAATCTTCTAGTAAGGCGATGTTGAAGACCTTGGGGAGGC |

| Locus | | Sequences |
|---|---|---|
| | Protein (SEQ ID NO: 839) | GACTGGGGGTTATGTGGGCTATTGGATATGATTCTCCGAGAGGCGGCCGATTCGGGCTCTGAAGA<br>AGGGGTTATCAAGGATTGATTTGGAAACTCTTAAAGAAGTTGCTGCGGAGTACAAGTGA<br>MTNQEAQAVAKELGDIPLNQEKIQAEIQRLNRKTFVQLEQVKILHDWLEGKRQSRQSGRVVGESRTG<br>KTMGCDAYRLRHKPKQQPGQPPTVPVAYIQIPQECGAKELFGVLLEHLKYQVVKGTIAEIRDRTMRV<br>LKGCCVEMLIIDEADRFKPKTFAEVRDIFDRLEIPVILVGTDRLDAVIKRDEQVYNRFRSSHRFGKLSGE<br>EFKRTVEVWEKRVLLLPVASNLSSKAMLKTLGEATGGYVGLLDMILREAAIRALKKGLSRIDLETLKE<br>VAAEYK |
| TniQ | DNA (SEQ ID NO: 840) | ATGGAAGCGATCGATATCCAGCCTTGGCTTGTTTCGGTTGAACCGTTGGAGGAGGAGAGTTTGAG<br>CCATTTTGGGCGCGTTTCGACGGGCGATCGCTGAATAAGTTAACGCCGATGGGTTGGGTAAGATGCGG<br>GGTTGGGAGGCGCGATCGCCCGTTGGGAGTTGAAAAGTTTCGCTTTAATCCGCCTCCTTCTCCTCAGCAGT<br>TGGATGCGTTGGCGCGCGTGTGCGAGTTGAAAAGGAACAGTTACAGGAAATGTTACCGCTCCT<br>GGGGTGGGATGAAGTTAGAGCCGATTCGGTTGTGTGGGGCGTTGTGTGCCCAGTCGCCTTGTCA<br>TCAGATTGAATGGACAGTTTAAGACACAAGGATGCGATCGGCACAAATTACGCTTGCTGTCGG<br>AGTGTCCCAACTGCGCGGGCCAGGTTTAAGATTCCCGGCGTTGTGGGTGATGGGTGTGTTCTCGG<br>TGTTTTTTGTCCTTTAAAGATATAGTAAGTGGCAGAAAACTACTTTGCCATAA |
| | Protein (SEQ ID NO: 841) | MEAIDIQPWLFRVEPLEGESLSHFLGRFRRANKLTPNGLGKMAGLGGAIARWEKFRFNPPPSPQQLDA<br>LAAVVGVEKEBQLQEMLPPPGVGMKLEPIRLCGACYAQSPCHQIEWQFKTTQGCDRHKLRLLSECPNC<br>GARFKIPALWVDGWCSRCFLSFKDIVKWQKTTLP |
| Cas12k | DNA (SEQ ID NO: 842) | ATGAGCCACATCACCATCCAGTGCCGTTTAGTCGCTAGCGTTCCGACCCGCCAACTCTGGGA<br>ATTGATGGCAGACAAAAACACGCCCCAATCAACGAACTACTGGCACTCTAGCCACTCCAATCACCCCG<br>ACTTCGAGACATGGGCGACAAAAAGGCAACTTCCCAGCCGTACAGTCAACAACTGTGTCAGCCT<br>CTCAAAACCGACCCCCCGTTTCATCAGTCAACCCGCACGGTTTACACCAGTGCCATTAAGGTTGTG<br>GACTACATATACAAATCTTGGCTTGCCTTAATGAAGCGGTTGCAATACCAATTAGAAGGGAAAAC<br>CCGCTGGCTAGAAATGCTCAAAAGCGATGCCGAACTCGTAGAAAGTAGCGGTGTCACCTTAGAA<br>ACTCTCCCGCCAAAGCTACTGAAATTTTGGCTCAATTAACACCCGAGTCCGACTCCGTTGCATCT<br>CAACCACCAAAAGCTAAAAGTAAAAAAGAAAAAATCAAGAATAAGACAGATATTTGAATCTATGCGCCATCAGCT<br>TATCTCACATTTTATTTGATGCTTATCCGAATCAACGATAAAGAAGACAAAATAAATTAGCCAACG<br>ACCTACTCAAAAATGCTGCAAATTCAGATTCAACGCTCAGAACTACTGCTCGAATTCCCAAAG<br>CCGCGCCAAAGTCCAAAAGTCCAACCATACTAGATGTTGGAGACATTAGCGAAGCTACATCCTGCTCAGCCT<br>GTCGAGATTTGACCAATACAGATAATAATATTCCAAGGAGGATCAAACGATCAACAAGAATTAACGAACCTCAAGAATCTGTGCCCATTTCC<br>AACGAAGCTCAAGCTAAATATTGCCAAGATAACTAACGAAGACATGACAGAAAACGTTTCAAGCCGTCTCTGTGTTAA<br>CATCATTTATGAAACTAACGAAGACATGACCTGGTTTAAAAACGTTTCAAGCCGTCTCTGTGTTAA<br>ATTCCGGCTTAGGCGACAATATACCTTTCAAGTGTATTGCGACCAACGCCCACTTGCACTGGTTCCA<br>ACGATTTTAGAAGACAAGAAATTAAGAAACAGCAAAGATAACAATCAATCAATCCAGTGGCTTATTTA<br>CCCTCCGTAGTAGTAGTCATGGCATGCAAGAAGGAAGGAGAGCCGTGGAACCTTCA<br>CCATTTAACCCTCTACTGTTGCGTGATACCGCCGTGGACCTGCCAGGGACAAACAGGTAA<br>AAGAGAAAAGCTACCGAAATCCTTTACCAACGCAAAATCCTCACCAAAGCCAAGAGAAGGCGACCTAAA<br>TCAACAGCAACAATCCTTTATCCACGCAAATCACCTTTACTAGAATCAACAATCCTTTCCC<br>GCGTCCCAGCCAACCTTTATATCCAGGGCTCAAGGTAACAATTTTAGTTGGCCTTAGTCTAGGTTTGGA<br>GAAACTGCAACTGTAGCCGTAGTAGATGCGATGCGACACAACGCCACACCAAAGTTATTACCTACCGTAGCATCC<br>GCCAGCTACTCGGCCGAGAATTACAAATTGCTTAACCGACCGCTTTCAATCAATTGGGAGAGTCTGAGTTAGGTG<br>CATGAACGTCAAACGCCCAAAGACGAGACGCGTTTCAATCAATTGGGAGAGTCTGAGTTAGGTG<br>AATATATCGACAGATTACTCGGCAGATTACTCGGCAGATTGAGCGATCGCGCAAATAACCAAGCTGGTAGC<br>ATTGTTTTACCCAAACTCGGCAGATATGCGGAAATAGTTCAAGCGAATTCAAGCCTTAGCGA<br>ACAAAAATGCCCAGATTTTTAGAAGGGACAGCAATAGTTCAAAACAATATGCCAAACAATATCGCTCAGCGTTC<br>ATCAGTGAGTTACCGCCAGATTAATTGACTCAGACTCAGGCGAAAAAGCTTGCATTGCG<br>ATCGAAGAGGCAGCAGCCAGTTGAGGTAGTCCCCAGACAGGGCGAAAGAGTTGGCGATCG<br>CGGCCTATCACTTACGTTCTAAAGCTTAA |

TABLE 29-continued

| Locus | | Sequences |
|---|---|---|
| | Protein (SEQ ID NO: 843) | MSHITIQCRLVASLPTRRQLWELMADKNTPLINELLALVANHPDFETWRQKGKLPSGTVKQLCQPLKT DPRFISQPARFYTSAIKVDYIYKSWLALMKRLQYQLEGKTRWLEMLKSDAELVESSGVTLETLRSKA TEILAQLTPESDSVASQPPPKAKSKKKKKSKALDSKPNVSHILFDAYRNTADILNLCAISYLLKNGCKIN DKEEDQNKFSQRRRKVEIQLQRLTEKLTARIPKGRDLTNTRWLETLAEATSCVPQNEAQAKYWQDNL LKGFSLVPFFIIYETNEDMTWFKNVSSRLCVKFSGLGEHTFQVYCDQRHLHWFQRFLEDQEIKNSKD QHSSGLFTLRSSMAWQEGEGKGPWNLHHLTLYCCVDTRLWTAEGTKQVKEERKATEIAKILTKAKE KGDLNQQQQSFIQRKNSTLTRINNPFPPRSQPLYQGQGNILVGVSLGLEKPATVAVVDAIAHKVITYRS IRQLLGENYKLLNRPQRQAQRSSSHERQNAQRRDAFNQLGESELGEYIDRLLAKEIVAIAQKYQAGSIV LPKLGDMREIVQSEIQALAEQKCPFLEGQKYAKQYRVSVHQWSYARLIDCIQTQAKKLGIAIEEGQ QPVRGSPQDRAKELAIAAYHLRSKA |
| OFCD01000028.1 | TnsB | |
| | DNA (SEQ ID NO: 844) | ATGTTGAATCAGCAGCCAACAGATCCGGTAGCACCGGAGACTGCACCGAGAGTAATGAAATAATTGCCACGCTTTC AGCCAATGCGAAATTCGGCTAGAAGTGCTACAGACGCTGGTTGTTCCGGCAATCGGACAACCT ATGGAGAACGATTGCGAGAACCAGCCCAAAAACTTGGGAAATCGATCCGACTGTGCAGCGGAT GGTCAAGGACTGGGAACGAAATGGCTTGTCAGCCTTGAAGGTGGTGCAAGAGCGGATAAAGGG CAACCACGCATTGGGCACGAGCTGCAAGATTTCATTATCAAGACTACCAAGAGTGGCACTAAAG ACAGCAAGCTATTACTCCGGCACACAGTGGCGGTTCGGGTTAAGGTACGGGCACAGCAATTGGG CGTAGAGAAATATCCCACCACATGACGGTTTATCGACGTTCGCCGGCTTCGCTCAACCAGGCA AGCAGCAGAATAATAAGCAATTGAGTATAGCAATCATGTTTGCCAATGTGACCACACTCGTGCGACGT GGACAAGGATTTAGCACCATGGGAAATGTTGGGACGCCTTGGCTGACACGGTAATCGATACCT TTTGCTGGTTGACCACGAATCGGGAGATTTGGGATTAATTTGGGGTTTGATGCACCCAGTTCTCAGCTTCTGTGCGTTGG CCTTGCTTCATGCAATGTGCCGAAACGCTATGGGAGCGAATATGGCTGAATTGAATTGTGAGTGGGGA ACCTCCGGAAGCCGGAGTCTTTACGGTGGATAACTATAACCAGCCGCGATGAAGGATCAAA GCAAGTCTCAATGCAGATTGGGTTTGTTGCCACTTGCCGACTCGGCCTTCGGCGGATTTTACGGAGGGCGTAG TTGACGCGGCCATTTGCACTTGGCACTGGAATACTGAGTTTTTCTCACACTTGCCTGGATATACGGGGTCAA ATGTCCAAGATCGGCCAGGAGGAAGCGGAGAAATCAGCTTGTTTGACCCTGAGAGAACTGGAGCA GCAACTGGTTCGGTACTTGTGGATAACTATAACCAGCCGCGATGCCCGGATGAAGATCAAA CGCCCTTTCAACGGTGGAGGCGGGATCGGCTTCGCTAATCCGATATTTTACGGAGGCGGAATTG GATATTTGCCTGATGAAGCAAACCCGACGGTTACCGACGAGGGCTATCTACGCTTTGAAGA TTTGACCTATCGGGGAGACGATTTATGTTACCGACTGAGGGGAGAAGGAGGTCTTTCTTACCAAT GCTCATGCTCAGGATTTGGAAACTGAGACGATCGCCGTTGATGAAGCGAAAGCCAGTAGCCGCA GGGTGCGGGGACGGGAGAAAACCATTAGCAATCGATTCAATCGATTCTAGAGAGGTGCGGATCGGGA TGTATTTGTCGAGAAGAAGCAGAAGGGTCGGAAGGCAAGGCAAGGCAAAAAGCAGAACAGGAACCCTTG CCCAGTCGGCCTCAACCGACCGAGTCGGATAGAAATTGCGGCCGTTGAACCGACGAAATCGTCGAAA AGACTGGGGTGGATGAATCCTGGGTAATGCCAGAGGTTATGATTATGACCAACTACATGATGAT TTTGGGTGGTAA |
| | Protein (SEQ ID NO: 845) | MLNQQPTDPVAPESNEIIATLSANAKFRLEVLQTLIVVPGNRTTYCGERLREAAQKLGKSIRTVQRMVKD WERNGLSALEGGARADKGOPRIGQEWQDFIIKTYQSGTKDSKRITPAQVAVRVKVRAQQLGVEKYPS HMTVYRILEPLIAKKEQQNNKRSIGWRGSRLSLSTRAGQDLAIEYSNHVWQCDHTRADVLLVDQHGE MLGRPWLTTVIDTYSRCIVGINLGFDAPSQLVALALRHAMLPKRYGSEYGLNCEWGTSGKPEHFFTD GGKDFRSDHIQQVSMQIGFVCHLRDRPSEGGVVERPFGTLNTEFFSHLPGYTGSNVQDRPEEAEKSAC LTLRELEQOLVRYLVDNYNQRLDARMKDQTRFQRWEAGLIANPDIFTERELDICLMKQTRRTVREG YLRFBNLTYRGENLAGYAGETVVLRFDPRDITTYVYRITBGEKEVFLTNAHAQDLETETIALDREAKASS RVREAGKTISNRSILEEVRDRDVFVEKKQKGKRARQKAEQERLPSRPQPQSVEIAAVEPDEIVEKTGV DESWMPEVMDYDQLHDDFGW |

TABLE 29-continued

| Locus | | Sequences |
|---|---|---|
| TnsC | DNA (SEQ ID NO: 846) | ATGACGACAGTTCAAGCAGCACAGACCGTTGCGGATCACTTGGGCCAGTGGCATTGGCCAGTGA GAAGGTTCAAGCCCAGATAGCTCGGTTAAACCGCAAGAGTTTGTCGAATTGGCTCAAGTGCAAA GCCTGCATGTTGGCTGCTGGAAAGTAAACGGCAGTCGAAGCAATGCTGTCGTTCGTGGGGGAATCA CGGACGGGGAAAACCTTGGCTTGTGATGCTTACATTCAAGTGCCCGCCATAGGCCGAGCCAACAACCAG AAAGCCGCCGATCGTACCCCTGATTACATTTAAGTGTCATCAGATGGTAAGGACGTGGCAGGAATCGGGA TCCAAATCATCATCGAGCATCTTAAGTATCAGATGGTGAAGGACGTGGCAGGAATTCGGGA ACGGACAATGCGAGCGCTTGCAGGGTTGTGCGGATATATTTTGACAAACTGAAGATTGCCGTGGTGCT TGAAGCCCAAGACTTTTGCGAGGTGTGGATGGCCGGATAGAGATGCTGATCATTGATGAGGCCGATCGG GGTGGGTACCGATCGGCTGATGGTGTGGGAGACGCAGGTTACAACCGTTTTCGGG CCTGTCATCCGTTTGGAAGTTACCTGTGGCCTCGAATTTGACGAGTAAGTCGATGAGGTGATTGGAG GCAGTGCTGAAGTTACCTGGCCTCGAATTTGACGAGTAAGTCGATGAGGTGATTGGAG AGGCGACGGCAGGGTATATCGGTTGATGAGTAGCGCGAAGGAATGCGGCGGGAGTATCGATTG AAGAGGGATTGCCGAAGATGATTGCGAAGAATGCGAAGGGCGGCGAGTATCGATGA |
| | Protein (SEQ ID NO: 847) | MTTVQAAQTVADHLGPVALASEKVQAEIARLNRKSFVELAQVQSLHGWLESKRQSKQCCRVVGESR TGKTLACDAYRLRHRPSQOPGKPPIVPVIYIQVPQECGSKELFQIIIEHLKYQMVKGTVAEIRERTMRAL KGCGVEMLLIDEADRLKPKTFADVRDIFDKLEIAVVLVGTDRLDVVVKRDEQVINRFRACHRFGKLA GEEFQRTIEVWEKQVLKLPVASNLTSKSMKVIGEATAGYIGLMDMILREAAIRSLKKGLPKIDLETL KEVAAEYR |
| TniQ | DNA (SEQ ID NO: 848) | ATGATGGACGATCTAGAGATTCAGCCTTGGTTTTTCCAAGTGGAACCTTATGAGGGGAGAGTAT TAGCCATTTTTTGGGGCGGTTTCCGCGGCGAAATGAGCTAACTCCGGGTGGGTTGGGGCAGATGG CGGGGTTGGGGCGGCAGTCGGGGAATCGGGGGTGGGAGAAGTTTCGGTTTAATCCTCGTCGACGGGGGA GCAGTTGGAGAAACTGGCCGGTGGTTGGGGTGCCGACGAGCGGCTATGGCAGATGTTGCCG GGGGATGGGGTGGGGATGAAGATGCGAGCCGATTCGGTTGCTGTGGGCTTGCTCTATGGGAGGTAG CTTGTCATCGGATTGAGTGCAGCTTAAGGACAAGTGGGTGCGATCGCCACCAATTGCGGTTG CTATCGGAATGCCCTACTTGTGAGCAAGGTTTTCAGTTCCAGCTTGGGTTGAGGGTAATTGT AAGCCGGTGCTTACTCCTTTTTCAGCAATGCTATGCATCAGAAATCGATTGCTTGA |
| | Protein (SEQ ID NO: 849) | MMDDLEIQPWFFQVEPYEGESISHFLGRFRRANELTPGGLGQMAGLGAAIGRWEKFRFNPRPTGEQLE KLAVVVGVPTERLWQMLPGDGVGMKMEPIRLCGACYGEVACHRIEWQLKETSGCDRHQLRLLSECP TCGARFSVPASWVREGNCKRCFTPFSAMAMHQKSIA |
| Cas12k | DNA (SEQ ID NO: 850) | ATGAGCAACATTACAATTCAATGCAAGCTCGTTACAACTGAGGTAACTCGTCATTACATCTGGCA TTTAATGCAGAAAAACACACTCCTTTAATCAATGAATTACTAAAGTGTATTGCCAAGATTCCC ATTTTGAGGAGTGGTGCCACGCGGGCAAAATTCCCTTGAAGATTCTATTCCTCAGCAACCGCTACCGTA TTACAGCAAAATTCTCAATTTATAGGACAGCCTGGAAGATTCATTCCTCAGCAACCGCTACCGTA TATCGAATCTGCAAGTCCTGGTTAGCTCTTAGGACACGACTTAGAAACCAGATTGCGGGTCAAAC TCGATGGTTGGCTATCCTCCAAAGTAATGATGAGTTAACAATCGCTAGCCAGAGCGACATCGACA TGCTGAGACTCAAAGCCCGTCAACTTCTCACGCAACTAATCACTCAGATTCCCAGGACAACGAA CCACAACCTCTTAAACCAGCAAAAAAAAGAGGAGAAGTCTTGACTGACGTGCGATCGCTTACCTGC GACCCTCTTTACACTCTATGGTGAGACAGAAGTTCTTGACTCACTCAAGGTGCTTACCTGT TTAAAACGGTTGCAAACTGCCCGATCGACTGAAGCTGAAGACTCCCCAAAAAGTTCGCCAAACGTCGTCGT AAACAGAAATCCGCCTTGAAGCTCTCGTCAAGACTTTAACCAAGGCAGAAGGTTTCTGTTTCCAAAGGACG ACATTGTCTGAGCATACTTGGTTAGAAACTTTAACCAAGGCAGAAGGTTGTGTTTCCAAATG ACAATGAAGCAGCCGATTGGCAAGCCAGCCTGCTAACAGGACCAGCTACTTTACCTTTTCCAATC AACTACGAAACAAATGAAAGATTCTCCGCTGGTTCAAGGAGATTTCTACTGTGAATGAAAAAGGAAGACTATGTGTCAGCTT TAATGGCTTAGGTGAGCAATTCATTTGAATATTTACTGTGATCAAAGGGATCTCCACTGGTTCAAGCG TACCTCTAGAAGACCAACAGACTAAGAAAACTAGCCGAGACCTAGCCAGCCAGCTATTCACCT TACGCTCTGGCAATGCTGGCAGCAGAGGGTAAAGGCCAGGTAAAGCCCTGGAATACTCATCG GTTAATTTATCTTGCCACTGTAGACACGAAGTTATCGCTAGCACTCAAGAGGTACGAACAAATTGAGCAA AGAAAAAAGCTAGTGAGTGTGCAAAAGTAAAGGCCCAGAAGAAGTACGAACAAATTTGAGCAA GAACCAAGAAGCATTTATTAAAGACGGACAACAATGCTGACTTTGCTTAGCAGGTGAAGCTATGGCTTGATA GTCCAAGCCGCCCTCTTTTATCAAGGTCAGCCATCGATTTTAGCAGGTGAAGCTATGGCTTGATA AACCTGCTACTCTCCGATTGTCGATATTCAAACTGGTAAAGCTATCACGTACAGAAGTATCCGA |

TABLE 29-continued

| Locus | | Sequences |
|---|---|---|
| | | CAACTTCTAGTGAAAACTATAAGCTTCTCAACCGATATCGTTTGCAGCAACACAACGCTCA TCAGCGGCAAAAGAACCAGCAAAAAGTGCATTCAATCGGTTTGGAGAATCCAACTCAGGAGAA CATCTAGACCGTCTAATAGCTCATGAAATCGTGGCGATCGCTCAAAAGTATCAGTGAGCAGCCT TATATTGCCTGACCTTAGCAATATTCGAAGAAATTGTCCAAAGCGAAGTTCAAGCTAAAGCAGAGC AAGAAATTCCCGGTTCTGTAGAACTCCACGCAATATGCCCTTCAAAGACGAAGCCGAAGTGCACAT CGTTGGAGGCATGCTCAACTTAGCCAGTATATCGGAGCCTAGCTGCCCAAGCCGGAATTTCTAT TGAAGTAGTAAAACAACCATTTCAGGAACCCCTCAAGAGAAGGCTAAAAATTAGCGATCGCA GGTTATCAATCTCGAAAATAA |
| | Protein (SEQ ID NO: 851) | MSNITIQCKLVTTEVTRHYIWHLMAEKHTPLINELLKCIAQDSHFEEWCHAGKIPLEAVRKTCKQLQQ NSQFIGQPGRFYSSATATVYRICKSWLALRTRLRNQIAGQTRWLAILQSNDELTIASQSDIDMLRAKAR QLLTQLNHSDSQDNEPQPKKARSKKKESKQPGSAISSTLFTLYGETEEVLTRCAIAYLLKNGCKLPDRA EDPKKFAKRRRKTEIRLERLVKTLQRTRPPKGRDLSEHTWLETLTKAEGCVSKDDNEAADWQASLLT EPATLPFPINYETNEDLRWFLNEKGRLCVSFNGLGEHSFDIYCDQRDLHWFKRFLEDQQTKKASGDLH SASLFTLRSGRIAWOEGKGEGEPWNTHRJLILSCTVDTDSWTQEGTEQIRQKKASECAKVIASTVKEN LSKNQEAFIKRRTTMLTLLDKPFFRPSRPLYQGQPSILAGVSYGLDKPATLAIVDIQTGKAITYRSIRQLL GENYKLLNRYRLRQQHNAHQRQKNQQKGAPNRFGESNSGEHLDRLIAHEIVAIAQKYQVSSLILPDLS NIREIVQSEVQAKABQEIPGSVELQRQYALQYRASVHRWRHAQLSQYIGSLAAQAGISIEVVKQPFTGT PQEKAKKLAIAGYQSRK |
| OFDP01000089.1 | TnsB DNA (SEQ ID NO: 852) | ATGGATGAAAGCCAAATTGCATTAGAAGCTGATTTGCAGGATCTGATGAGGTTTTGTTGAGCGA TCGAGCCTTTGACACGCAGATCCATCCCAAATTTTAATTGAATCGTCAGATCCACAGAAGTTACGCTT TCGTCTAATTGAGTGGCTAGCGGAGGCTCCCAATCGAGGAGCGATCCAATCGAGGTAGAGCCGTTGCTGATACAATGATGA GCAGTTACATGAAACTGCCGAATGCTGTTCAGACAGAAGGCAACATGGATTGGCGACTATT GGCCGAAATATATCCCAGTGCTGTATGAACAAGAAGTGTCAAAGATAAACACCCGCTCACTCCAGCG AATATTGTGCGAGAGGTTCACCGTCACGCATTAATCTAAAACCTCATCGAACAGCAGCGAAGAAGTGACTATCC TCATCAAGCAACTATCTACCGGATTCTAAAACCTCATCGAACAGCAGCGGACGAAGCGAAAAGTAAGA GATTTTAGCACATCAGGATCGTTCAGTGCGACCATACAAGTTAGATGTTCGGATCGTGATGAGGA TGGCAAGCTTTTAAACTGCGAACTTGGCTTCCACCATGTTGCTGATACTTCTCAAGCTGTCTGAT TGGCTATCATTTGTGCATAAACAGCCAGGATCCATGAAGTTCAGAAGTTCGATACGCATACAGACCATGCCA CTTCCAGTATTTTTTTACTGATGGCGGCAGAGATTTAGCTCAACATGAGCTTCAGAAGTCGGGACATCTGGATTCCAA AATAAGTTCGGTTTTCAGTGCGAGAGCTGCCGAGATGCGACCGATTCAAGGTGGCATTGTTGAGCGACT ATTCCGGACGACAATTAATACACAGGTTTACACAGGGACTCTTGCTGGCTACATATCACCAGAAGAAGATG GCGCAAAACGGGCAGAAAAGGAGGCTTGTCTAACTATTGAAGATGTTGACAAGATTCTAGCCGCT TACTTCTGTGACGACTCAATCATCAGCCATATCGTAAGATTCCCGTGATAGCCGTATGAAGAA ATGGTTAAGGACGAATGGGGGCAAGTTGCCAGAAACAGAACACTGAGCGAGGATCTAGATATTCTC CTTACTAAGGACAAACAAAAACTCGTTCAGGAGTATGGATCATGTCAAAGGTCATGGATGAT CCAATGTAAAGAATTGGAGCCATTTAAAGTCACCTAACCTATCACCAGAGATCCGACCATG TTCTGACGTTATATATTCACTCAACCTATTGGCGAGCGAGAAGTGAATTTATCTGCTGTTC ATGCCAATACATGGACATTCAAGATTTTGACTCTGTATGAGCTGAAACAATTTAACAAGGAGAA AGTACAACGAAACGAGACTCAATATAGTGCGGCTATAGCTTTGGATAAACGACAAAAGC TTGTAGCAGAAGGAAGCAGGACAGAGGCAAGAAGGAGCGTCAACAGGCAGGGCAGAAGAACTGCGAG GAAAAGTAAGCAGAATCCAGAACTGCGAATGGTGGAAATGCGGAAGGTTCGAGCTGGTAAATCTGTAG AAACAACGACCGATGGAACTTCCTGCACCCCATTCTTGCCGAAACGATGAAGCCTCAGCCT CTGGTAGCCGTATCTCCTGACCATTCTTGAGCCTGATGCTTCTACACCTGAAGACCGAACCG CATCGACTTGTTATTGCTAAAAATCAAAAAATGAAGAGGGACTGGTAA |

TABLE 29-continued

| Locus | | Sequences |
|---|---|---|
| | Protein (SEQ ID NO: 853) | MDESQIALEADLQGFDEVLLSDRAPDTDPSQILIESSDPQKLRPRLIEWLAEAPNRKVAERKKIAET LDISTRQVERLLDRYNDEQLHETAGIDRSDKGQHRIGDYWPEYIRSVYEQSVDKHPLTPANIVREVH RHALIDLRHEEGDYPHQATIYRIILKPLIEQQKRKSKIRNPGSGSWMSVETRDGKLLKADFSNQIVQCDH TKLDVRIVDEDGKLLNWRPWLTTVDTFSSCLIGYHLMHKQPGSHEVALTLRHAALPKNYPPEYELQ KSWDICGLPLQYFFTDGGRDLAKSKLIKAFGNKFQCELRDRPIQGGIVERLFGTINTQVLQPLAGYIS PEEDGAKPAREKEACLTIEDVDKILAAYFCDDYNHQPYPKDPRDTRYEKWLRGMGGKLPETLDERDLD ILLTKEKQKLVQEYGSIYFETLYTQCKELEPFKGQYVTVTYDDPHVLTLYIYTQPIGERESEFICCVHAN NMDIQDLSLYELKQPNKEKSTTKREHSNYSAAIALDKRQKLVAERKQGKKERQQAGQKELRGKSKQ NSNVEMRKVRAGKSARNNEPMELLPERVTPEQMKPQPLVALSPAPILEPDASTPRTTERHRLVIAKN QKMKRDW |
| TnsB | DNA (SEQ ID NO: 854) | ATGGCACAATCAGAACTGCCAATTCACGTTCCTGTTGAAGTTTAACTACCCAGTTAGATATGACT GACTTGCTCGGCTAAAGCAGCAACGATCGAGGAGCTATTCAAGACGGCATTTATTCCAACCGATCG ACATTCAGAGTATGCTCGATGGATAGAATTACGAATTCTCAAACATGTGGTCGAGCGATCG GGCCAAGAGATGTGGGGAGAAAGTCCTTCGTCAGTCAATTATCGAGAGGAGATATAAGCGGGT TTCATGTGTTAAGGCATGGTCAAATTCAAGCTCTAAGCGGTTGTTTTCACAAATCCTCAAAGACAT TAACCATGGCAGCTTGGAGAGGTAAGCCAAAAGATTTACAAGCTAGATTAGCTGCTGTTTAGAAC TATTTGGGAATGAGCTGCTGTTAAATGATAATGCTGATAATTTACAACGGAGGCTTTGATTGACC TAAAGCAGCTTCATGAAGAATCTGAGTGCCGATCGTCTTAATTGGTGGGCAGGATCTTGACAAC ACCCTGGTAAATTTCGATTTACTGACTGTTTTCCGACATTATTGAGTTGATGCTCTAGGTGAA GAGGACTTAAAGAAAACATTGGAGACGATCGAATTAGATATTCTGGCACTTCCCCAAGCATCTAA TTTGTCGGAAGAAGGCTATTTGAAATTTTGCAGATAGTTCTCAAACTCGAATTGGTATTTTGAT TAAAATCCTATCAAAGACTGTTCTACATTCGTTGAAAAAGGTCATGGAAAGTTGAGGAAGAGA TTCTGAGAAATAATTGCTAATCGGTATGGGCGACGGTACGTTCCGTTGGAAGCTAGAAATAAGCCG CAGTCGATCGAGGGTTGA |
| | Protein (SEQ ID NO: 855) | MAQSELAIHVPVEVLTTQLDMTDLLAKAATIEELFKTAFIPTDRHSEYARWIDELRILKHCGRAIGPRD VGKSRSSVNYREEDIKRVSCVKAWNSSSRLFSQILKDINHAAWRGKPDLQARLAGCLELFGIELL LIDNADNLQREALIDLKQLHEESGVPIVLIGGQDLDNTLVNFDLLTCPPTLFEFDALGEEDLKKTLETIE LDIIALPQASNLSEGRLFEILRDSSQTRIGILIKLSKTVLHSLKKGHGKVEEEILRNIANRYGRRYVPLE ARNKPQSIEG |
| TniQ | DNA (SEQ ID NO: 856) | ATGGGAGAGTCTGCTTTGAGTCAGCTTGACGATCGAGTGCCCTGCCTAGTTATGTGAACCATT TGAGCATGAAAGTATCAGCCATTATCTCGAGACGGTTGCCGCCGGATTTTAAGGCGAATAGTCTGCCGT CGGCTTATGCGTCTAGGGCAGGCGCAGGAGTTGGGATCGATCGCCAGTTAACGGTTAATGGTTAGATTTGTC TTTCAATCCATTTCCGACTGATGAGGAGTTGGGATCGATCGCCAGTTAACGGTTAATGGTTAGATTTGTC GCGGTTTCAGGATATGTTGCGAGCCGAGAAATCACGTTTCAACCTGCCGATTCGGCTCTGTGT GGCTTGTTATGGAGAAAGTCCAGTCATCGATGAATGCCAGATGGACAAGGATGGGTGCGGTTT GTCAGCGTCACAGTCTGCCACTATTGGAGCGATGCCACAATGCAAGAGAGCCGTTTGAGATTCCA GCGTTATGACGTCCATGCCATCACTGTGGATGCCGGTTTACGTCGATGGTGAAGTATCA GGAGAGAATCAATAAGCTATCTGA |
| | Protein (SEQ ID NO: 857) | MGESALSQLDDRVPWLGYVEPFEHESISHYLGRLLRRFKANSLPSAYALGQAAGIGGITVRWEKLYFNP FPTDEELGSIASLIGLDLSRFQDMLPSREITFQPRPIRLCVACYGESPGHRMEWQYKDVVAVCQRHSLR LLERCPQCKKPFEIPALWTADRCHHCGMRFPTSMVKYQERINKAI |
| Cas12k | DNA (SEQ ID NO: 858) | ATGAGCATCCATGCTTACAATTCACTGTCGCCAGTGACTTCTGAGCCTATTCGTGCCACCTCTGGCAC CTCATGGCAGAGAGATCTGGCAAGCAGGTAATACCCCATTGGTCAACGAACTGACAAAGTTAGTCAGCAGGAG ATTTTAAGATCTGGCAAAGCAAAGTACCATTTCCAAAAGATAGTTCAGCTTTATGCAAACCG ACCTATAAGTCATGGCTGCGAATTCAGAACAATCTTCGCTATCGACTGATGGAAAGCAACGCTG GTTGAATGTAGTCACAAGCATCGTGAATTGCACGAAGCTTCAGCGTTCTAATCTTGATGTCATCA AGCAAAAGGCACAAGACGAAAGCAAAGCCTGTAAAATGCCACACAAACATCCAACGATGACAATCTGATGT CATAAGCTATTCACTGCTTATGATGATAACAGAAAGAGAAGAAAGATGCAAATGCGCAATTCCTACCTGC TCAAGAATGACTGCAAAGTTTCGGAAATAGAAGAAGACCCAGATGATTTGCCCACCGCATCAAT |

TABLE 29-continued

| Locus | | Sequences |
|---|---|---|
| | | CGTAAGAAGGAACAGATCGAGCAACTTGAGGCAGCAGAACTGAATGCTGATTACCTAAAAGTCGGG<br>ATCTCTCAGGGCTGAGTTTCTGAAAACACTAGAACTCGCGACTACCAAATTTCCGAAAATGTT<br>GCTCAGGCAAAAGAGTGGGAGGCTAAAATTGAAAATCTGCATCTCTGCCATATCCCATTAT<br>CTATGATAGTTCTGGGGAAGTCCGTTGGGCAAACAAATCTGACCCAAAGGGCGATAACTGTCAACTTCA<br>ATGGTATGGATAAATATCTCAAAGAGTCGATCGACGACAATTACCTTTGTTCCAACGCTTTGGAAGAT<br>GAGAATCCTTTCCAGTTGTATTGCGAATAAAGATACATATCCCCAGGTTTACTCACGCTCAGTCAGGCAT<br>TGGCAAGCCTATGACAGAAGGCGAATAAAGATAAGGCGATCCTTGAATGCTAACCATCTTGCCCTCCACT<br>GCTGATTTGGACAGAAGGCGAGGTAAAGGTAAGGCGAATAAGCGATCCTTGAATGCTAACCATCTTGCCCTCCACT<br>GCTCTTACGATACTGCTTAATGACCGCAGGAATCGCTTGTTCACCAGGAGAAATCCGAT<br>GAAGCTCTTAAAAACCTAGAGGGTGAAAAGCCCGATCCTCGCAAACGATCGGAGCTAGCTCGAC<br>TGCAAAATATACCCGCTCGTCCCAGCCATAAACCTACCAAGGTAATCCCGAAATTTGGTTGA<br>CTCAGTATCGGACTAGCCAATCCTGCCGCAGTTGTTAATGTCATAACGGAGAGGTACT<br>GACCTATCGCACTCCCAAGACATTACTGGGCATCGATCGTCTTCGAATCGTCATCGTACTAA<br>ACAGCAGCAAAATATCTTACAACGTCAAAAATCAGAAACGTGGAATTTCCGATCAGCTATCAG<br>AATCAGAGCTGGAGAATATGTAGACCGTCTATTGCCAATGAGATTGTTAAACTTGACAACAA<br>TATCCAGCAGATAGCATCGTAATTCCCAGTCTGACCATCTGAGAGAAGTACTTAATAGTGAGAT<br>TACTGCTAGGGCAAAACAGAAATGCTCTGCCTCTGTTGAAGCTCAAAACAAATATGCTAAAGAGT<br>TCCGTATGAGAATTTCCCGCTGGAGCTACAACAGATTTCAGCCAGTCAGAGCTAGTCCTCAAGAACGAA<br>AGACTCGGTATCACAATTGAGTCAGGATTTCAGCCAGTCAGAGCTAGTCCTCAAGAACGAGCGAA<br>AGATGTGGCGATCGGAGCTATCACTCTCGACGAAATTCTGCTGAATGA |
| | Protein<br>(SEQ ID<br>NO: 859) | MSIVTIHCRLVASEPIRRHLWHLMAESNTPLVNELTKLVSQQEDFKIWQSKGTISKKIVTALCKPLRKV<br>YPGQPGRFYSSAIAMVLYTYKSMLAIQNNLRYRIDGKQPRMLNVVKSDREIHELSGSNLDVIKQKAQE<br>ILDRLNAVTNEVESAPNAKKRKAKQKAKSSNDDNLMSKLFTAYDDTEDTLSKCAISYLLKNDCKVS<br>EIEEDPDGFAHRINRKKEQIEQLEREAELNARLPKSRDLSGAEFLETLELATYQISENVAQAKEWERAKLET<br>KSASLPYPIIYDSSGEVRMGKTTKGRITVNFNGMDKYLKAVDPDIQKWYEVHQENPFQLYCDRRQLP<br>LFQRFWEDMQAYEPNKDTYPPGLLTLSTAMLIWTEGEGKGDPWNANHLALHCSYDTRLMTAEGTAL<br>VQQEKSDEALKNLEGEKPDPRKRSELARLQNIPARPSHKPYQGNPEILVGLSIGLANPVTAAVVNVITG<br>EVLTYRTPKTLLGDRYRLLNRHRTKQQQNILQRQKNQKRGISDQLSESELGEYVDRLLANEIVKLAQQ<br>YRADSIVIPSLTHLREVLNSEITARAKQKCPGSVEAQNKYAKEFRMRISRWSYNRLIEAIRSKARRLGIT<br>IESGFQPVRASPQERAKDVAIGTYHSRRNSAE |
| OGVQ01000026.1 | TnsB<br>DNA<br>(SEQ ID<br>NO: 860) | ATGTACCCGCACAATAGCGAATTACTATTTTGTCTAAGTCCACTATGGATGAAATACCTATCTTC<br>AATCAAGACAAAGAATCTCTGAACCTGATGACAACAATGATTTGGCAGAAATTCAGAATGATGA<br>GTCAAGAAGACAAACTGCTTAATTATTACCGAACTTTCGGCTGAAGCAAAACTCAAGATGGAAGTG<br>ATTCAAGGTCTACTTGAACCATGCCAGAACTGTCCAGCGTTAGTTGAACAACCTATGTCAGAAATTAAGAGTAGCAGCAGA<br>AAAACTGGGCAAGACTGTCAGAACGTGTCCAGCGTTAGTTGAACAACCTATGTCAGAAATTAAGAGTAGCAGCAGA<br>CCGCAATTGTTGACACTTGAGAGAAGCAGTTATCGGATAAGACCCTGAGTGCAAAA<br>ATTTATTATCAGCACTTTTAAGAAGTAATAAGGGTAGTAGTAAAAATGACTCCGGCTCAAGTAG<br>CAATCAGGGTACAAGTCAGACAGGACAGCTAGGTTTAGAAGCAAAAGCAAAACATTAGATGATCATAGTAAT<br>TACGAGAGTTCTTAACCTATTATTGAGCGGAAAGACAAAACAGAAAGTACGGAATGTTGGAT<br>GGGCGGGGGTCACGACTGTCACGACTGTCAAAACTCGTGATGGCGAAAACATTAGATGATCATAGTAAT<br>CATGTTGGCAGTGCAGTGACCATACAAAATTACAGACAGAGTTCATGTTGGTGATCAATATGGTGAGCCTTTG<br>TCTCCCCCTTGGTTCACCAGTTCTCAAGTGGTAGCCCTAGCATGTCAGTTACTCTCGTTGTATCATGGGTATTCATTTGGGC<br>TTTGACGCACCAAGTTCTGAAGTGGTAGCCCTAGCATTACGCCATGCATGTCTATTTGCCAAAGCAGTAT<br>AGTGCGTAGAGATTTTCGCTCGACACCACTTAAAACAGATTGGTTCCAATTAGGTTTGAGTGTCAT<br>TTACCGGATCGCCCCAGTGAGGTGTATTAGGCTCTAATATTGAAGAACGTAGTTTGGCACTATCAATACAGAAT<br>TCTCTCTGTTTCTATGCGTATTAGGCTCTAATATTGTTAGTTCGCTACATTATTGACAACTATAATC<br>AGCGTCTTGATGCGTCACGTAACAAAGAGCAATCAAGGTTTCAAAGATGGGAAGCAGGATTACCTGCT<br>CTACCCAAAATGGTGAAGGAGCGCCGAATTAGATGTCTGTTTGATGAAAAAACTCGACGCGTAT |

TABLE 29-continued

| Locus | | Sequences |
|---|---|---|
| | | TTACAAAGGCGGATATCTCAGCTTTGAAAATATTATGTATCGAGGAGACTACCTAGCAGCTTACG<br>CTGGGGAAAGTATTGTACTCAGATATGATCCCAGGGATATTACAAGTGTTTGGGTTTATCGAATA<br>GATAAAGGTAAGGAAGAGCTTCTTTCTGCTGCTCATGCCGTTCATGCCTGGATTGGGAAACAGAGCAATTATC<br>TTTAGAAGAGGCTAAAGCTGCTAGTGCAGAAGTGCCGTTCTGTGGTAAAACACTCAGAATAAAT<br>CCATTTTAGCAGAGATACACGATAGAGATACTTTCATCAAGCAAAAGAAAAGACTCAGAAGA<br>ACGCAAAAAGAAAGACTTCAGAAGAACAGCCTAAGTTCATCCTGTTTATGAATCCATCAATCCAGTGATACCG<br>AACTGGTAGAAATTCCAGAAGAACAACTACGTCAAGACTATGATGAGTAG<br>TTTCAACTATGAACAACTACGTCAAGACTATGATGAGTAG |
| | Protein<br>(SEQ ID<br>NO: 861) | MYPHNSELLFCLSPTMDEIPIFNQDKESLPFDDNDLAEIQNDESEETNVIITELSAEAKLKMEVIQGLL<br>EPCDRKTYGQKLRVAAEKLGKTVRTVQRLVKKYQQDGLSAIVDTERNDKGSYRIDPEWQKFIISTFKE<br>GNKGSKKMTPAQVAIRVQVRAGQLGLEDYPSHMTVYRVLNPIIERKEQKQKVRNVGWRGSRVSHKT<br>RDGQTLDVHHSNHVWQCDHTKLDVMLVDQYGEPLSRPWFTKITDSYSRCIMGIHLGFDAPSSQVVAL<br>ALRHAILPKQYSAEYKLHCEWATYGPVENLFTDGGRDFRSDHLKQIGFQLGFECHLRDRPSEGGIEER<br>SFGTINTEFLSGFYGYLGSNIQERPKTAEEEACLTLRELHLLLVRYIIDNYNQRLDARTKEQSRPQRWE<br>AGLPALPKMVKERELDVCLMKKTRRSIYKGGYLSFENIMYRGDYLAAYAGESIVLRYDPRDITSVWV<br>YRIDKGKEBILLSAAHALDWETEQLSLEEAKAASRKVRSVGKTLSNKSILAEIHDRDTFIKQKKKTQKE<br>RKKEEQAQVHPVYESINLSDTELVEIPEETPKTQAPQSRRPRVFNYEQLRQDYDE |
| TnsC | DNA<br>(SEQ ID<br>NO: 862) | ATGAAAGACGATTATTGGCAGAAATTGGTACAAAATTTATGGGAGATGAACCAATTCCAGAGG<br>AATTACAGCCAGAAATTGGTGAAAATGGTTTGCGCTTTCCCAAACAATGGTCGAATTGTTGCACCTCCACGA<br>GCAGTAAGTCGGTTTCTTCTGTGATGTATAAGATGCCACCAAAAGAGAGGTAA<br>AAAAGATATTGTACCTGTTTTTGTATATGCAGTTCAGGAGATTGCTCATCGGGTGAATTATTAGT<br>TCTGATTCTGGAAAGTTGAAATATGAGTCAACTAAAGTGAAATGCTAATTATTGATGAAGCAAATTTTCTCAAG<br>TACAAGACTACTCAAAGATAAGAGAATCTAAAGTGAAATGCTAATTATTGATGAAGCAAATTTTCTCAAG<br>TTGAATACTTTTAGTGAAATTGCCCGAAATTTACGACTTGCTGAGAATTTCCATTGTTCTGTAGGT<br>ACGGATGGTTTTGGATAAATCATCAGAGAAAAGAGCCTTACATTTAAAAATTTGGAAGAAGAGGTTTT<br>AGATTACCATTAGTAGTATCAGAGAAAAGAATTTCTCACAAGAAAGAAATGAAACTTTATTACCTTTGTATCAAAAACCAG<br>ACGTTTACCTCTCCCTTCTAATCTCACAAGAAAGAAATGAAACTTTATTACCTTTGTATCAAAAACCAG<br>TGGCAAAATTAGATTAAAGAGATCTAGTAGATCGGTATTGAGAAGAAGACTTCAATTTTAGCCTTGAGAAAAGGAT<br>TGAAGAAATAGATTAAAGACTTTAACTGAAGTTTAGATTGGTTTGAATAA |
| | Protein<br>(SEQ ID<br>NO: 863) | MKDDYWQKWVQNLWGDEPIPEELQPEIERLLTPSIVELDHIQKIHDWLDGLRLSKQCGRIVAPPRAGK<br>SVSCDVYRLLNKPQKRGGKKDIVPVLYMQVPGDCSSGEELLVLILESLKYESTTGKLTDIRRRVQRLLK<br>ESKVEMLIIDEANFLKLNTFSEIARIYDLLRISIVLVGTDGLDNLIKKEPYIHDRFIECYRLPLVSEKRFSE<br>LVKIWEEEVLRLPLPSNLTRNETLLPLYQKTSGKIGLVDRVLRRASILALRKGLKKIDKETLTEVLDWF<br>E |
| TniQ | DNA<br>(SEQ ID<br>NO: 864) | ATGGAAATTGCTGCGGATGAACCTCGTTTTTTTGAGGTAGAACCCCTGATGAGAAGTTTAAG<br>TCATTTCTTAGGTCCGTTTTCGCCGAGAAAATTATTAACCTCTACCCAGTTGGGTAAATTGACTGG<br>ACTCGGTGCAGTTATTTACGTTGGGAGAAGTTGTATTTCAATCCTTTTCTACTCTACCAAGAGTT<br>GGAGGCTTTGCTCCTCTGCTGGGAGTTAATGTGGGGAGTTAATGGATAGGTTAATGGAGATGCTCCATCTCAGG<br>GAATGACGATGAAGCCTAGACCAATTAGGTTATGTGGGCGCTTGCTATGCAGAATCTCTTGTCAT<br>CGGGTTGATTGGCAGTTAAAGGATAAAATCAGGTGATGGCTACACTGACGAAGACATCCCA<br>TAATTTACGCTGTGTTAACGAGATGGTACTAACTGTGAAACACCTTTTCCTATTCCCGCAGATTGGGT<br>ACAAGGTGAATGTCCTCACTGTTTCCTGCCTTTTGTAACAATGGCGAAGCGTCAGAAGCCTAGCT<br>AA |
| | Protein<br>(SEQ ID<br>NO: 865) | MEIAADEPRFFEVEPLDGESLSHFLGRFRRENYLTSTQLGKLTGLGAVILRWEKLYFNPFPTLQELEAL<br>SSVVGVNVDRLMEMLPSQGMTMKPRPIRLCGACYAESPCHRVDWQLKDKIRCDGYTGRRHPHNLRL<br>LTKCTNCETPFPIPADWVQGECPHCFLPVTMAKRQKPS |

TABLE 29-continued

| Locus | | Sequences |
|---|---|---|
| | Cas12k DNA (SEQ ID NO: 866) | ATGAGCGTTATCACTATTCAATGTCGTTTGGTTGCTGAAGAAACAGCCTCCGGGAACTCTGGGA<br>ATTGATGACTGAAAAAAATACACCATTCATCAATGAAATATTGTACAGGTAGAAAACACCCA<br>GAATTTGAAACTTGCTAGAAAAGTAGGATACCTGCTGAATCACTCAAATACTTGGTAATTC<br>CCTCAAAACTCAAGAACCTTTACTGCAGCGTTTTACACCTCAGCGATTACCTTAGT<br>GGATATCTGTATAAATCCGGTTGCCTTGCAAAACGCAGAAAACCAAATAGAAGGGAA<br>CAGCGTTGGCTAAAAATGCTAAAAGTGATCAAGAACTAGAACAAAAGTCAATCTAGTTTAG<br>AAGTAATTCGCACTAAAGCTGCCGAACTTCGACTAAATTGCACCTCAGTCTGATAGCGAAGCG<br>CTCCGTAGGAATCAAAATGCAAAAGAGTGCGGAAAAAGACTAAAAATCCACAAAATCTA<br>AAACATCTTCAATTTCAAATTCTTTAAACACTTACGAAGAACACAGAGATATTCTTACTCATT<br>GCGCTTCTTGCATATCTACTCAAAAAATACTGTCAAATTAGTGAAGTGGATGAAAACCAGAAGAA<br>TTTACCAGAAATAAGCGCAGAAAGATTGACAGGAGAAGAATGGTTAGAAACCTTAAAAATTGCCACCTTA<br>GCATCCCTAAAGCTAGAGATTTGACAGGAGAAGAATGGTTAGAAACCTTAAAAATTGCCACCTTA<br>AATGTTCCGCAAATAGAAAATGAAGCAAGCATGGCACAGCACTGTTTAAGAAAACTGCTA<br>ATGTTCCCTTTCCTGGCTTATGAATCAAACGAGGATATGACATGTTAAAAATGATAAGAAT<br>CGTCTCTTTGTGCCGTTCAATGGCTTGGGAAAACTTCTTTGAGATTTATTGCGATAAACGTCAT<br>TTGCACTACTTCCAACGCTTCCTAGAGATCAAAGAATTCAAGAATAGTAAAATCAACATTC<br>AAGTAGTTTGTTTACTCTACGCTCCAGAAGAATTTCTTGGTTGCCAGGTGAAGAAAAGGTGAAC<br>ATTGGAAAGTAAATCAACTAAATTTTATTGTTCTTTAGATACTCGAATGATGACTTATGAAGGAA<br>CTAAACAGTAGTTGAGGAGAAAGTTACAGCAATTACCGAAATTTAAATAAACCAAACAGAA<br>AGATGATCTCAACGATAAACAAAAAGCCTTTATTACTCGTCAGCAATCACTCTAGCTCGAATTA<br>ATAATCCTTTTCCTCGCCCCAGCAAGCTAATTATCAAGGTAAATCTTCTATCCTAATAGGTGTTA<br>GTTTTGGACTAGAAAAAACCAGTTACAGTGCAGTGGTAGTATAATTTACTAAATCGTCAGCGACAACACA<br>TATCGCAGTGTTAAACAACTACTTGGGAAAACATAATAATTTACTAAATCGTCAGCGACAACACA<br>GCAACGCTATCTCACGAACGCACAAAGCCAAAACAAAAGTCACCCAACTCTTTTGGTGAAT<br>CAGAATTAGGGCAATATGTGATAGATTATTGGCTGATGCAACTAATTGCGATCGCCAAAACTTAT<br>CAAGTAGTAGTATTGTTTTACCAAAACTCCGCGATATGCGAGAGCAAATCAGCAGTGAATTCA<br>ATCCAGACGAGAACAGATGTCCTGGTTCTAAGGACGATTAATCGAGAGTAATGCTAAAGATAT<br>CGGATTAACGTTCATTCGCTGGAGTTATGGACGACAATCAATCAGAGCTAGTCAGTCTAA<br>AGCTAGCTGTTTTTGCTTACCAAAAACGTGAAACTGGAACTGGACAACAATCAATCAGAGCTAGTCAGTCTAA<br>GATGTAGCTGTTTTTGCTTACCAAAAACGTGAAACTGGAACTATTAAGTCAGTCTAA |
| | Cas12k Protein (SEQ ID NO: 867) | MSVITIQCRLVAEENSLRELWELMTEKNTPFINEILVQVGKHPFETWLEKGRIPAESLKILGNSLKTQE<br>PFTQQPGRFYTSAITLVDYLYKSWFALQKRRKNQIEGKQRWLKMLKSDQELEQKSQSSLEVIRTKAAE<br>LLTKPAPQSDSEALRRNQNDNQKKGKKTKKSTKKSTKSSIFKILLNTYEETEDIILTHCALAYLLKNNCQI<br>SEVDENPEEFTRNKRRKEIEIERLKDQLQSRIPKGRDLTGEEWMLETLKIATLNVPQNENEAKAWQAALL<br>RKTANVPFPVAYESNEDMTWLKNDKNRLFVRFNGLGKLTFEIYCDKRHLHYFQPRLEDQEIKRNSKN<br>QHSSSLFTLRSGRISWLPGEEKGEHWKVNQLNFYCSLDTRMMYEGTKQVVEEKVTATTEILNKTKQ<br>KDDLNDKQKAFITRQQSTLARINNPFPRPSKPNYQGKSSILIGVSFGLEKPVTVAVDVVKNEVIAYRS<br>VKQLLGENVNLLNRQRQOQQRLSHERHKAQKQNAPNSFGESELGQYVDRLLADAIIAIAKTYQASSIV<br>LPKLRDMREQISSEIQSRAENRCPGSKEGQKKYAKEYRINVHRMSYGRLIESIQSQAAQAGIAIETGTQ<br>SIRASPQEKARDVAVFAYQKRQTIKSV |
| CP031941.1 | TnsB DNA (SEQ ID NO: 868) | ATGCTGGACGACTATCATACCAATAGCGAGCAAGAGGCAGAAAAGGATGAGATCGTCACGAACTCT<br>CAGCAGCTGATAGGCCATTTGCTGGATATGATTCAGCAACTACTCAGCAACCGTGCGATCGGCGAC<br>TATGGAGAAGACAAAGGAGGTCGCAGCCAAACTAGGCAGTCGTGCGAACGGTACGGCGAC<br>TGGTAAAAAAATGGGAAGAGGAAGGAAGGTTAGCGACTTCAATCCAAACTTATAAGGAAGGCAATAAA<br>CAAACATCGAATAGCACACTGATGCAACAGTTCATCATCCAACAGTTCATCAGATGTAAGATACAAGGCGCTGATTAG<br>GGTAGTAAGCGAATTACTCCCCAACAGTAGGACTGTGATCGACTTCTACAACCCATTATGAGCAGCAA<br>GACAAAAAAATATTCCAGCTATAGGAAGTGGAGGTTCTGAGTTCTCAGTGTTCGGCATGGTTCTGAGTGCATGTTCGCCAGTTGGACGTTCTCAGTTTTGAATTGCAGCAA<br>TGGTAAAGACTTATCAGTAGAATATAGCAACCATGTTTGCAGTTGGACCATACTCGTGTAGACC<br>TATTGCTGGTAGATCAGCAGATGGTGAACTTTTGGCTCCTTGGCTGCAGTTGGTGACAACTGTTGTATACTT |

TABLE 29-continued

| Locus | | Sequences |
|---|---|---|
| | | ACTCCCGTTGCATCATGGGGATAAACTTAGGCTTTGATCCTCCGAGTTCTCAGGTAGTAGCATTAG |
| | | CACTGCGCCATGCAATTTGCCAAAGCAGTATGGCTCAGAATATGGACTTCATGAAGAATGGGGA |
| | | ACCTACGGGGAAACCAGAACATTTTATACCGATGGTGGTAAAGATTTTCGCTCAAACCATTTGCA |
| | | ACAGATAGGTCTGCAATTGGAATTTGTTTGTCATTTACCGCATCGCCCCAGTGAAGGTGTATTGT |
| | | TGAGCGTCCTTTTGCACTTTAATACCGACTTCTTTTCTAATATGCCGGATACACAGATCAAA |
| | | TGTGCAGGAACGTCCAGAGCAAGCTGAGAAGGAGGCTTGTCTGACTTTACGGGAGTTGGAACAT |
| | | AGGTTTGTACGCTACATCGTGGAATAATATAACCAGCGTCCTGATGCGCGTCTTGGCGATCAAAC |
| | | TCGCTATCAACGATGGGAAGCAGGGTTAATTGCTTCTCCTAATGTAATTTCAGAAGAGGAGTTAC |
| | | GTATTTGCCTGATGAAGCAAACTGCACGCTCTATTATAGAGGGTGAATATCTGCAATTTGAAAATC |
| | | TGACCTATCCGGGGAGAAAATTTGGCAGGTTATGCAGGTGAAAGCGTTGTACTGCGCTATGACCCC |
| | | AAAGACATTACAACTGTGTTGGTTTACCCGCAAAGTGTAATAAAGCGGAACAGCGTGTTGATGAGCCGA |
| | | TTCGGCAAGCAGGAAGATGATTAGCAACTGCTGCAGGGTACGCGATCGCGAAAC |
| | | TTTCCTGACCCAAAAGAAAAACCAAAAGGAACGTCAAAAAGCGTGAAGATTACGGGTGCTAA |
| | | GCTAAACACCATTGATAGTTGACCAGAAGAAATTGAAGTGCCATTGTTGATGAGCCAGA |
| | | ATACCAGATGCCAGAGCCTTTGATTACCAAACAAATGCGTGAAGATTACGGGTGCTAA |
| Protein (SEQ ID NO: 869) | | MLDDHTNSEQEAEKDEIVTELSAADRHLLDMIQQLLEPCDRITYGERQREVAAKLGKSVRTVRRLVK |
| | | KWEEBGLAALQTTTRADKGKHRIDTDWQQPFIKTYKEGNKGSKRITPQQVAIRVQARAAELGQKKYP |
| | | SYRTVYRVLQPIIEBQQEBQKAGVRSRGWHGSRLSVKTRDGKDLSVEYSNHVWQCDHTRVDLLLVDQH |
| | | GELLARPWLTTVVDTYSRCIMGINLIGFDPPSSQVVALALRHAILPKQYGSEYGLHEEWGTYGKPEHFY |
| | | TDGKDFRSNHLQQIGVQLGFVCHLRDRPSEGGIVERPFGTFNTDFFSNMPGYTGSNVQERPEQAEKE |
| | | ACLTLRELEHRFVRYIVDKYNQRPDARLGDQTRYQRWEAGLIASPNVISEEELRICLMKQTRRSIYRG |
| | | GYLQFENLYRGENLAGYAGESVVLRYDPKDITTVLVYRQSGNKEEFLARAFAQELETEQLSLDEAK |
| | | ASSRKIRQAGKMISNRSMLAEVRDRETFLTQKKITKKERQKAEQAVVQKAKQPLIVEPEIEVALFDSE |
| | | PEYQMPEAPFDYEQMREDYGW |
| TnsC | | ATGACTTCAAAACAAGCTCAAGCAGTTGCCCAACAATTAGGTCAAGCTTCAGCCAATGTGAAAA |
| | | ATTACAAGCAGAAATTCAAAGATTGAACCGGAAGACTTGTATCCTCTTGGAGCAATGAAATTC |
| | | TTAATGACTGGCTAGAAGGAAAGCGTCAAGCACCGTCAGTCTGGTCGTATTGTAGGAGAGTCCAGA |
| | | ACTGGTAAAACAATTGGGTTGTAGATCGCCTACAGACTCCGGCATAAACCAAGCAAGAGGTAGGAA |
| | | AACCACCATTCGTGCTACTTTCTGAAGACATTCGTCTGATTGTAGTGCTAAAGATTTGT |
| | | TCAATGAGATTCTTAAGCATTTAAAGATTCAGATGAATAAGGAACGTAGCTGAGATTAGAGAA |
| | | CGCACATTTGAGTTCTTAAAGGTTGCGGGTGAGATATTTTGACAAGTTAGAATTGCGGTGATTTTGG |
| | | GAAACCCAAAACTTTTGCTGAAGTGCGATAGCGACGAGATATTTATAACCGCTTTCGTGCC |
| | | TGGGTACCAGATTAGACGCTGTAAGTTTCTCGTGAAGATTTTTAAGCGAACTGTGGAGATTTGGAAAGCA |
| | | AGTTTTAAAACTGCCAGTTGCTCTAATCTTCCAGCAAGACGATGCTAAAACTTAGGTGAGGC |
| | | AACGGGGGTTATATTGGTTTGCTAGAATATGATTTTGAGAGAATCAGCAATTCGGGCGTTAAAGA |
| | | AAGGATTACAGAAAGTTGATTTGGAGACTCTGAAGGAAGCTTACGGCGGAGTACAAGTAA |
| Protein (SEQ ID NO: 871) | | MTSKQAQAVAQQLGEISANGEKLQAEIQRLNRKTCILLEQVKILNDWLEGKRQARQSGRIVGESRTGK |
| | | TMGCDAYRLRHKPKQEVGKPPFVPIAFLEDIPSDCSAKDLFNEILKHLKYQMNKGTVAEIRERTFRVL |
| | | KGCGVEMLIIDEADRLKPKTFAEVRDIFDKLEIAVILVGTDRLDAVIKRDEQVNRFRACHRFGKFSGE |
| | | DFKRTVEIWEKQVLKLPVASNLSSKTMLKTLGEATGGYIGLLDMILRESAIRALKKGLQKVDLETLKE |
| | | VTAEYK |
| TniQ | | ATGGAAGTTGTAGAAATGTCAACCTTGGCTGTTTCAAATAGAACCTTTACGGGAGAAAGTTTGAG |
| | | TACTTTTTAGGGCTGCGTTTTGCGACGGCAAATGATTTAACGCCTACTGGATTAGGTAAAGCCACAA |
| | | AACTTGGGCGTCGCGATCGCCCATGGAGAAAAATTTCGGTTAATCCCCGCTCGCCAGCAA |
| | | TTAGAGGCATTGGCTAAGGTTGTAGAGGTTGATGCTAGTGATTAGTGCGCAGATGTTACCGCTGC |
| | | TGGGGTGGAGATGAAGCTTGAGCCGATTCGGTTATGTCGTCGTTGTTGAGTCAGCTTATCA |
| | | TAAGATTGAATGGCCAGTTGAAGATAAGAATTAAGGTTCCAGCAGTGTGGCGATGGTTGGTGTCAACGG |
| | | TGTTTTCTGAGTTTTGCCGAGATGTAAGTATCAAAAGTCTTATCGATGA |

TABLE 29-continued

| Locus | | Sequences |
|---|---|---|
| Cas12k | Protein (SEQ ID NO: 873) | MEVVEIQPWLFQIEPLQGESLSHFLGRFRRANDLTPTGLGKATKLGGAIARWEKFRFNPPPSRQQLEAL AKVVEVDADRLAQMLPPAGVEMKLEPIRLCAACVVESAYHKIEWQLKITQGCDRHQLILLSECPNCG ARFKVPAVNADGWCQRCFLSFAEMVKYQKSYR |
| | DNA (SEQ ID NO: 874) | ATGAGCCAAATCACTATTCAGTGTCTTCTTGTAGCCTTAGAGTCATCACGCCAGCAACTATGAA GTTGATGGCTGAGTTAAATACGCCATTGATTAATGAACTACTACTGCAGTAAGTCAACACCCAG AGTTTGAGACTTGGCGACAAAAGGCAAACACCCCACTAGTATTGTCAAGGACTCTGCCAACCT TTGAAAACTGACCCTCGCTTTATCCGTCAGCCTGACGGTTTTATACGAGTGCGATCGCATTGGTG AACTACATCTATAAATCATGGTTTGCCCTAATGAAGCGATCGCAGTTCCAACTAGAAGCAAAAT TCGCTGGTGGAAATGCTCAACAGTGATGTTGAATTGCTAGAAAGTAGTGTGTCAGCTTAGATA GTCTTCGCACTAAAGCTGCTGAAATTTTGGCTCAAATTTCTTCTCAATACTGCTGAAACTCCATC AACAATGTAAAAAAGCTAAAAAGCGCAATAACAGAAGATAACTTGACTCGTTGGCCATCAGCTA TTTGCTCAAAATGTTGCAAATAAACGATAAGAGGAAGACGTAAAAATTGCTCAACGTC GCCGTAAACTTGAAATTCAGATTGAACGCATCAGAGAACAGCTAGAAACACGAATTCCCAAGG TCGAGATTTAACCGTTATCAAATGGTTAGAAACATATTGTTGTTGCCACTCACACCGTTCCAACAAA GAAGCCGAGGCAAAAATCTTGGCAAGACAGCCTTTTAAGGCAATCTAGCACAAGTACCTTTCCCG TAGCTTACGAAAGCACAAGACATGACTTGGTTTAAAAACCAGTTGGGCGTATCTGTGTAAAA TTCAACGTTTGAGTGAGCATAGTTTTCAAGTCTATTGTGATTCTCGCCACCTTCACTCGTTTCAA CGCTTCCTAGAAGATCAACAAATTAAGAAAAATAGTAAAAACAGCACTCTAGTACCTCTGTTCAC CCTGCGTAGTTGGGCGTATTGCTTGGCAAGAAGAAGAGGAAGGCAAAGCGATCCTTGGAATGTTAATC GCTTAACCCTCTACTGTTCTGTTGGATACACGCCTATGACGCACTGAAGGAACCAATCAAGTAAGG GAAGAGAAAGCTGAAGAAATCGCTAAAGAAATTATCACTAAACAAAAGCCAAGGCGACCTTAATG AAAAACAGCAAGCCCACATAAAACGGAAAAACTCCACCTTAGACAAGCAGAATTAATAACCTTTTCT CGCCCCACTAAACCTTTATAAAGGACAATCCTATATTCTATTGGTATTAGCCTCGGCTTAGAA AAGCCTGCACGCGTAGTAGACGCATAGTACCAGGTCAAGTAATTACCTATCGCAGCATCAA ACAACTACTGGTGATAATTACAAACCTGCTAAATGACACAGCACAGTTGGAACAGCATTTTTATCCC ACCAACGCCAAATAGCTCAAACGCTTGCTGCCAAAATCAGTTGGAGAATCGGAGTTAGGGGA GTATATTGACAGATTACTAGCGAAAGAGATTATTGCGATCGCCAAAACATACTCTGCTGGAAGTA TTGTTCTACCTAAGTTGGACAATATGCGACAAGCAAGTTCAAAGTGAGGTTCAAGCCAAAACTGAA CAAAAATCAGCATTATAGAGAAGTTCAACAAATTATGCTAAATAGTACCGAGTTAGCGTCATCA GTGGAGTTATGGCAGATTGATGGCAAATTCGAGTAGTCACTCGTCAGCTGTTAAAGCTGAATTGTGATAG AGGAGTCAAAACAGCCAATTCGAGTAGTCCACAGAGAAAGCGAAAGAATTAGCGATCTCCGC TTACCATTCCCGCAAAATAAACTGA |
| | Protein (SEQ ID NO: 875) | MSQITIQCLLVALESSRQQLWKLMAELNTPLINELLRQVSQHPEFETWRQKGHPTSIVKGLCQPLKT DPRFIGQPRFYTSAIALVNYIYKSWFALMKRSQPQLEGKIRWLEMLNSDVELLESSGVSLDSLRTKA AEILAQFSSLNTAETPSTNVKKAKKRKAQNSDSDRNLSKNLFETYRNTEDNLTRCAISYLLKNGCKI NDKEEDAKKFPAQRRRKLEIQIERIREQLETRIPKGRDLTVVIKWLETIVVATHHVPTNEAEAKSWQDSLL RQSSKVPFVAYESNEDMTWFKNQPRICVKFNGLSEHSFQVYCDSRHLHWFQRFLEDQIKKNSKN QHSSSLFTLRSGRIAMQEEEGKGDPMNVNRLTLYCSVDTRLWTTBGTNQVREEKAEEIAKIITNTKAK GDLNEKQQAHIKRKNSTLDRINNPPRPTKPLYKGQSHLLIGISLGLEKPATLAVVDGTTGQVITYRSIK QLLGDNYKILLNRQRQQKHFLSHQRQIAQTIAAPNQFGESELGEYIDRLLAKEIIAIAQYSAGSIVLPK LDNMREQVQSEVQAKTEQKSDLIEVQQKYAKQYRVSVHQMSYGRLMANIHSSAVKAGIVIEESKQPI RGSPQEKAKKLAISAYHSRKIN |
| QVFW01000007.1 | TnsB | |
| | DNA (SEQ ID NO: 876) | ATGATTCAAGAGCTTGCAACAGCCTTTGATATTAGACAGAAAACAACAATCATCTTAATATTCAGCT AGATGAAAAGCCTCAAAACCTCAAAGACTACCCCTCTGACGAATTGCTTACTGACCAAGTAAACC GCAGGATAGAGGTGTTCAAAGCTGGTGTATCGCCATGCCATGCAAGCCATGATCGCAAAACTAAAAG CGGGAGGCTGCGCGAAACTGGGTGTCAACCCTATCGCTGCCGCTCAGGTAGAACGCTTGCTTCAGAAGTGGCG AGAACATGGGTTAGTTGGACTTTATCATCAATACTTATACCAACGGTAACAGGGCCAAGCGCGATGACTCG GATTGGGTAGAACTTTATCATCAATACTTATACCAACGGTAACAGGGCCAAGCGCGATGACTCG GCATCAAGTATTTATGCGGGTCAAAGAAGGAGCTAAGCAACTCCGCGTCAAAAAAGGTGAATAC |

TABLE 29-continued

| Locus | | Sequences |
|---|---|---|
| | | CCAAGTCACCAGTCGTTTATCGAATTCTGACCAACACATGAGCAGAAACGA<br>AAGCAAGAAGCCCAGGCTACTCAGGAGAGCGGTTGACACATGACTCCTGATGGGCGAGAGTT<br>GGAGGTCGAGGGTAGCAATGACGTATGGCAGTGCGATCATATCTCCTTAGATATCAGGCTTGTTG<br>ACGAGTATGCCGTTCGAATCCGTTGGCCCCTTGCTAACGATAATCATCGATTCCTATTCCCGTTGCGTGA<br>TGGGATTTTATTAGGATTCGATCATCACCCTAGCTCTCAAATTGATGCCTTAGCTTGCGTCATGCAA<br>TCCTACCTAAGTCTTATGGTTCTGGATATCAACTTCGTCACGACTGGGGACTATGGTAAACCCA<br>ATCACTTTTATACTGACGGCGGTAAGGACTTTACTTCACTATTACAGAGACGAAGTTGCCGTTC<br>AAATAGGTTTCAATTGCTCTTTGAAGAAGTACGACCATCAGATGTGGAATTGTCGAGCGTTTTTA<br>GGACGCTTAACGACCAAGTATTGCTGATTGCCAAGCTTACCACGGGTCAAACGTCAACAACGC<br>CCAGCAACCCTGATAAAGATGCTCGCCTGACTCCTGAAGGGTTTAGAAACGATTTTAGTGCGTTA<br>CATAGTAGATGAATATAACCAGCACGTAGATGCCCGTTCTGGAAACCAGAGTCGGTTGCAGCGGT<br>GGGAAGGCCGATTAATGGTAGATCCTTATCTATACGATGAATTGGACTTGGCAATTTGCTTGATG<br>AAGCAAGAGCCCGACAGTCCAGAAATACGACAATAAGATTTGGAGATCGGGATTTTGCAG<br>CAGAACATTTAAGAGGTCGAGCAGGAGAATTGGTTACAGTACGATTCGATCCTGATGACATCACT<br>ACTCTCTTCGTCTATCAACGCAATTGCATTTCTTTACGAGAACTGAAAGCGAAGAATTACTCCACGCTCTA<br>GATTTAGAAACTGAACGGCTTTCTTTACGAGAACTGAAAGCGAAGAATAAGAAGCTAGAGAA<br>CAGGTGAGGAAGAAATCAACAATTGATTTTAGACGCGATACGTCGTGACGAATTTGTGGAAAT<br>TTAGTTAAAAGAAGCAAACCGTCAGCAGCGCAAGCAGCCAGGAACAAGTAAATCCCACAGT<br>CTGTTGCTAAGAAAATTTGCTATTTCCAAACCAGAAGAAATAGAGGCAAAGTCTATGTCAGAAGCA<br>GAACTGGAAGTAGAGCTACCAAGATATCAAGTTCCTTCATGGACGACTTGTTTGAAGATGATTA<br>G |
| Protein<br>(SEQ ID<br>NO: 877) | | MIQDLQQPLLIDENNNHLNIQLDEKPVKPQRLPSDELLTDKVNRRIEVLQSLIEPCDRKTYGIKKREAA<br>RKLGVSLRQVERLLQKWREHGLVGLTATRSDKGKYRLEQDWVDFIINTYTNGNKGSKRMTRHQVFM<br>RVKGRAKQLALKKGEYPSHQSVYRILDQHIEQKDRKRKARSPGYSGERLTHMTRDGRELEVEGSNDV<br>WQCDHTRLDIRLVDEYGVLDRPWLTIIIDSYSRCVMGFYLGFDHPSSQIDALALRHAILPKSYGSGYQL<br>RHDWGTYGKPNHFYTDGGKDFTSIHITEQVAVQIGFNCSLRRRPSDGGIVERFRTLNDQVLRDLPGY<br>TGSNVQQRPATVDKDARLTLKGLETILVRYIVDEYNQHVDARSGNQSRLQRWEGGLMVDPYLYDEL<br>DLAICLMKQERRTVQKYGRIRFGDRDFAAEHLRGRAGELVTVRFDPDDITTLFVYQRNADGTEELLD<br>YAHALDLETTERLSLRELKARNKKRRETGBEINNSILDAMLDRDBFVENLVKRNQQRKQAAQEQVNP<br>TQSVAKKFAISKPEIEAKSMSEABLEVELPRYQVRFMDDLFEDD |
| TnsC | DNA<br>(SEQ ID<br>NO: 878) | ATGGAAGATTTAAGTCCAGAAATCCAGAAGAAAATTAAAGACTTAAGCCGCCCACCATACTTAG<br>AATTAGAACGAGTCAAACACTGTCATGCATGGTTGACAGTTACTTATATCAAGGATGACTGGT<br>CTATTGGTAGGAGAGTCTCGTTGCGGAAAAACTGTTACTTGTAAAGCTTTTACAAGCAATACAA<br>CAGATTGAAAAAACAACAGAGCAGCGGTTAAGCACGTAGTTCACATTCAAATTCCTAAAGCTT<br>GTGGTTCTAGAGATTTCTTTATCAAAGCTCTAAAAGCCTACAAATGGAACCATTT<br>CAGACTTACGAGAGCGAACGTTGATAGCTTGGAAATACATCAAGTGGAAATGCTAATTATTGAC<br>GAAGCCAATCACCTGAAATACGAAACGTTTTCTGATGTACGACATATTTATGACGAAAATGGATT<br>GGGAATTGCCGTTCTCCCTAGTCGGTACTACGACCAGCCGTTCCATGCAATAGTTAAGCGCGATGAGC<br>AAGTTCTCAATCGATTTCTAGAGCAATATGAATTAGAATCCTTAGAGACGTCCAGTTTAAGCAA<br>ATCTACAGATTTGGGAGCGAGATGTTCTGAATTTGCCAGTAGCATCCAACTTAGCAACAGGAGA<br>AAATCTAAAGCTTTTGAAGCAGGAACTCAGAAATTAATTGGTCGCCTAGATATGCTCCTTCGCA<br>AAGCAGCAATTCGCTCGTTACTTAGAGGGCATCAACAACCTAGACAAAGACGTTTTGAAGAAGTA<br>ATTACTGCAACTAAGTGGTGA |
| | Protein<br>(SEQ ID<br>NO: 879) | MEDLSPEIQKKIKDLSRPPYLELERVKHCHAWLTELLISRMTGLLVGESRCGKIVTCKAFTKQYNELK<br>KTQQGRFKPVVHIQIPKACGSRDFFIKILKALNKPTNGTISDLRERTLDSLEIHQVEMLIIDEANHLKYET<br>FSDVRHIYDENGLGIAVLVGTSRLHAIVKRDEQVLNRFLEQYELDRLDESQFKQIVQIWERDVLNLP<br>VASNLATGENLKLLKQGTQKLIGRIDMLLRKAAIRSLLRGHQNLDKDVLKEVITATKW |

TABLE 29-continued

| Locus | | Sequences |
|---|---|---|
| TniQ | DNA (SEQ ID NO: 880) | ATGGCTAAAACACTTAAAGAACAAAACTCTGGCTGACACGAGTTGAGCCATTAGAAGGGGAAA GTATTAGTCACTTTTTGGGTCGCTTTCGACGAGCAAAAGGAAATAAGTTCTCGACTCCGTGTT TAGGTCAAGTGTCAGGACTTGGAGCAGTGTTGGCTCGTTGGAGAAAGTTTATTTCAATCCCTTC CAACATTTGAGGAGTTGAGGGCGTAGCAAGTTGGTGGAAGTCGATGTTAATAGACTGCGAGA AATGCTGCCTTAGCTGGTTAGGGATGGATGAAACATAAACCATTAGATATGCGGAGCTTGCTATG CAGAAGAACCCTATCATCTGATTGCATGGCAGTTCAAGACTACAGCAGGATGCGATCGCCACCAG TTGCCGCTTGCTATCTAAATGCCCAATCTGTGAAAAACCGTTTCTATTCCCGCTTATGATAGAA GGACGATGCTGCCTTGTTTGACCTTTTTGCCGAAGATGTCGATCGCCAAAAAGCTTACTAG |
| | Protein (SEQ ID NO: 881) | MAKTLKETKLWLTRVEPLEGESISHFLGRFRRAKGNKFSTPCGLGQVSGLGAVLARWEKFYFNPPTF EELEALANVEVDVNRLREMLPLAGVGMKHKPIRLCGACYAEEPYHLIAWQFKTTAGCDRHQLRLL SKCPICEKPPIPALMIEGRCLRCLTFFAEMVDRQKAY |
| Cas12k | DNA (SEQ ID NO: 882) | ATGAGTCAGATTACTATTCAGTGTCGTCTTGTTGCTACAGAATCAGCCCGCCAACAGATGTGGAG GTTAATGGCAGAAATCAACACGCCATTAATGACTACTCGGCAAGTCGGTCAACACCCTG ACTTCGAGCAGTGGCGACAAAAAGGCAAGCTTCCATCTACTTTCATTAGCCAGCTATCCCAGTCA TTCAAGTCCGATCCCCGTTTTTAGGTCAACCAGCCGTTTTACAAATCTGCTTTTAATGCTGTGG AATACATCTACAAGTCCTGGTAGCTCTAAATAAACGGCTACAGCAGCAGTTAGACAGAAAAG GCGATGGCTAGAAATACTCCAGAGCGATACTGAATTAGCGGCAGTAGTAATTGCAGTTTGATG CTATTCGCAGTAAAGCTGCTGAAATTCTCTCAAGCTATACAAGCACCTAGCTTGGATTCTTCCC CACCTAGAGGTAAAAGGTAAAAAGTCTAAAGAAGATCTCTTCAAGCCCTGTTCTTCTAGCCTG TTGCTGAAATTGTTTAAGGCTTATCAAGAGACAGATGACATTAAATGCCGCTGCGCTATCAGCTAT TTGCTGAAAAATAACTGTCAACTCCGATCGCCAAGAGATCCAGAGAAATTTGCTAAACGTCG CCGTAAAGTTGAAATCCGGATTCAACGTCTTACTGAAACAGCTAAACAGCAGGATGCCGAACGGTC GAGATTTGACCAATACTAGGTGCTGGACAAGTGTTCTATTAACCAAACCGAAGTCTCTCCATTTCCACT GAAGCCCAAGCCAGACAGTGGCAAGATCTTTTGGTCAAAAAACCAAGCAAGATAGGCTCTGCGCTTCACT AATTTTTGAAACTAACGAAGACCTATTTTGGTCAAGATATTGCCGTCAGCTCAGTTCACTGGTTTCATC TCCCTGCTTAAGGATTTGCTTCCAAGTAATAGCAGCAAAATACAGTAGCATTCTAGTAGCTTGTTCACT GCTTTCTAGAAGACCAGCAGACTAAACATAGCAGCAAAGGAAGGCGAACCTGAATACCACT ACCTAATTTGTATTGTTGTTGATAACCCGTTAGCTGCAAGGCAAGGCGAAGAACTGAGCTGTACGTC AAGAAAAAACTGCGAAATTGAGAAGTTATCAATGAGACCAAGGCGAAGAACGATCTAACTGA GACGCAGCAAGCTTTATTCACCAAAATCCACGTTAGCTCGAATTAAGGTCATTTCGATC GCCCTAGCCAATCTATCTACCAAGTCAATCTCATATTTTAGTTGGAGTGAGCCTGGACTAGAC AAACCTGCTACAGGTGACAATTATAAACCTCTAACCAGAGAAAAGTCCTCGCTTACCGTAATACTCG ACAACTACTTGGTGACAATTATAAACCTGTCAACGCAGAGAGGCAGCAGCGGCGGTCCTTGTCTC ACAAGCGCCATAAGCTCAAAAACCGTCGACACCAATCAATTTTGGGAATCCGAATTAGGGCA GTATGTAGAGCGATTATTGCAAAGAGATTGTGCGATCTCGCAAGCCGAGATTCAGGCTGAGCAGA ATTGTTCTGCCTAAACTAGGCGATATGCCAGGAGATTCTGACAAGCGAGATTCAGGCTGAGCAGA AGCTAAATGTCCTAACTATGTTGAAGAGCAACAGCAAAAGTTCCAAGCAGTATCGGATTAGCATCC ATAAGTGGAGTTACGGCAGATTAATGCAAAAACATTCGAGGCCAAGAAATGGCAAGCTCAAGAGATTGTT GTTGAAGAAGGAAAACAACTGATTCGAGGCAGTCCGAAGAAATGGCAAAGATTAAGCGATCG CTGCAGTCCAATCTCGTCAGCCTGTAA |
| | Protein (SEQ ID NO: 883) | MSQITIQCRLVATESARQMWRLMAEINTPLINELLAQVGQHPDFPEQWRQKGKLPSTFISQLSQSFKSD PRFLGQPSRFYKSAPNAVEYIYKSWLALNKRLQQQLDRKRRWLEILQSDFTELAADSNCSLDDAIRSKAA EILSQAIQAPSLDSSPPRGKGKKSKGRSSSSPVSSLFANLFKAYQETDDIKRCAISYLLKNNCQLSDR EEDPEKFAKRRKVEIRIQRLTEKINSRMPNGRDLTNTRWLETLAIATTSVPQDEAQARQMQDVLLTK PKSLPFPLIFETNEDLFWSKNQQDRLCVHFPGLRDLAFQVYCDRRQLHWFHRFLEDQQTKHSSKNQHS SSLFFLRSAYLAMQQKEKGEPWNTHYLLIYCCVDTRLWTAEGTELVRQEKTAEIEKVINRTKAND LTETQQAFIQRQKSTLARIKGHFDRPSQSIYQGQSHILVGVSLGLDKPATVAVVDAIAEKVLAYRNTRQ LLGDNYKLLNRQRRQQRSLSHKRHCAQKRADTNQFGESELGQYVERLLAKEIVAISQNYRAGSIVLP KLGDMQEIILTSEIQARAEAKCPNYVEGQQKYAKQYRISIHKWSYGRLMQNIQSQAAQAEIVVEBGKQ LIRGSPQEMAKELAIAAYQSRQPQ |

TABLE 29-continued

| Locus | | Sequences |
|---|---|---|
| OOKZ01000026.1 | TnsB DNA (SEQ ID NO: 884) | ATGTTAAAACTATCTGAAGATAATAATCACGCGACAATCAAAAGCCAGAAGTCGGCGAGATTGTGG<br>CTGAAATAGCAGATGATAATAAGCAACTGCTGGAAATAATTCAGAAGTTGCTGGAGCCTTGTGAT<br>CGCCATTACCTACGGACAACGGCAAAGGAAGCTGCCGCTCAGTTAGGAAAGTCAGTGCCGACAG<br>TGCGACGACTAGTCAAAAGTGGGAAGAGAAGCTGCAAGATTTCATTATTAAAACTTATAAGGAG<br>AGATAAAGGCAAGCATCGAATCGAGCAAGACTGGCAAGATTTCATTATTAAAACTTATAAGGAG<br>GGTAATAAGGTAGTAAGCCATTACCCCCAAACAAGTTGCTGTTCGCGTACAGGCAAAGGCAG<br>CTGAACTAGGACAAGATCGATATCGATATCAGTTACACAGAACGTATATCGCGTCCTACAACCGATTATT<br>GAGCGGCAAGAGCAAGGCAAGCATTAGAAGTCGGGCAAGTTCGCGTTTGTCAGTCA<br>AAACTCGTAGACGTGCTGCTAGTAGATCGAAATGGTGAACTTTTAAGTCGCCCTTGCTGACGACAGT<br>TATAGACACTTACTCTCGTTGCATCATGGCTTTAACTTAGGCTTTGCTGCACCGAGTTCTCAGT<br>AGTGGCACTGCGCTGCGTCATCAACCTTTGCCAAAGCGTATGATTCGCAATACCAACTCCATT<br>GTGACGCGGGAACCTACGGTAAGCCAGAACACTTTTACCTGACGCGGCAAAGATTTTCGCTCC<br>AACCATTTGCAGCAGATTAGTGCCCAGTTAGGATTTGTTTGTCATTTACGTGATCGCCTAGTGAA<br>GGTGGCATTGTGACCGTCCATTTGGACTACCTGGAAGTGCAAGCTTGTTTTAACCTTAAGGG<br>ACGGGGTCAAACGTACAAGAACGCGAGCCAAGCTGAGAAGAAGCTTGTTTAACCTTAAGGG<br>AGTTAGATCGTTTGCTAGTCGCTACATCTGGATAAATACAACCAAAGTATTGATGCGCGTCTG<br>GGAGATCAAACTCGCTTCAGCGTTGGGAAGCTGGGTTAATTGCTGCTCCAATCCATTGCAGA<br>GCGAGATATGGATATTTGTCTAATGAAGCAAACTCGGCCTCAATCTATCGAGGTGGATATCTGC<br>AATTTGAAAACCTGATATATCGGGAGAAAATATGCTCGTTATGCAGGCGAAAGTGTTGCTT<br>AGGTATGACCCCAAAGATATCACTACCGTCTTAATTTATAGGCAAGAACAAATGTCTAGATGAAGCAAAGCTA<br>TTTAGCTAGAGCATTGCTCAGGATTTGGAAACAGAACAGATTAGCAATCGCTCAATTTTGCAGAAGTGCG<br>GTAGCCGCAAGCTTCGAGAGACAGGAAGACAACGATTAGCAATCGCTCAATTTTGCAGAAGTGCG<br>CGATCGCGAAACCTTTTAACTCAAAAGAAAAACTAAAAGCAACTCAAAAAGCAGAACAGGCT<br>GAAGTTCAAAGGTAAACACCATTGTCTATCGACCCTCAAGAGAGAAATAGAAGCGGCATCGA<br>TTCCAAATCAAGCAGAGCCGAGATGCCAGACATATTAACTCATTAACTACGAACAAATGCTCGAAGATTAC<br>GGGTTTTAG |
| | TnsB Protein (SEQ ID NO: 885) | MLKLSEDNHGDNQKPEVGEIVAEIADDNKQLLEIIQKLLEPCDRITYGQRQREAAAQLGKSVRTVRRL<br>VKKWEEGLAALSQTREDKGKHRIEQDWQDFIIKTYKEGNKGSKRITPKQVAVRVQAKAAELGQD<br>RYPSYRTVRVLQPIIERQEQQASIRSRGWRGSRLSVKTRDGKDLSVEYSNHVWQCDHTRVDVLLVD<br>RNGELLSRPWLTTVIDTYSRCIMGHFNLGFAAPSQVVALALRHAILPKRYDSQYQLHCDAGTYGKPEH<br>FYTDGGKDFRSNHLQQISVQLGFVCHLRDRPSEGGIVERPFGTLNTELFSTLPGYTGSNVQERPEQAEK<br>EACLTLRELDRLLVRYIVDKYNQSIDARLGDQTRFQRWEAGLIAAPNPIAERDMDICLMKQTRRSIYR<br>GGYLQFENLIYRGENMAGYAGESVVLRYDPKDITTVLIYRQEAGEEVFLARAFAQDLETEQMSLDEA<br>KASSRKLRETGKTISNRSILAEVRDRETFLTQKHTKKERQKAEQAEVQRVKQPLSIDPEEEIRAASIPNQ<br>AEPEMPDIFNYEQMLEDYGF |
| | TnsC DNA (SEQ ID NO: 886) | ATGAGTTCAAAGAAGAGCCAAGCTGTTGCTCAAGAGTTGGAGATATTCAACCCAATGATGCGA<br>GATTGCAAACCGAAATTCAGCGAATTCAGCGATTGAATCGTAAAAGTTTTGTCCCTCTAGAACAAGTAAAATT<br>CTTCATGACTGGTTAGACCGAAAACGTCAAGCACGACAGGGTTGTCGAGTCGTAGGAGAGTGC<br>GCACAGGAGAAAAACTATTGCTTGTGATGCTTTATAGATTGAGGCACAAGCCAATACAAGAACCAGG<br>AAAGCCACCTATTGTACCTGTGTTGTTTATATCCTAGTATCCAGACTGCGGTTCTAAAGACTTATT<br>TAGGTTAATTATTGAGTATCTGAAATATCAGATGACTAAGGAACAGTAGCTGAAATTCGAGAGC<br>GAACTCGGCGGGTTTGAAGGGTTGTGAGTAGAGATGTTGAAGATTTGGAATTACAGTTGTTTAGT<br>AGGAACTGACCGTTTAGATGCAGTGATTAAACCAGACTCCAAGTTTACCACCGCCTTCTGCTT<br>GTCATCGGTTGGTAATTATCGGGTGATAGTTTTAAAAGAACAGTGGAGATTTGGAAAGAAG<br>GTTTTGCAATTGCCTGTTGCCATCAAATCTTTCTAGTAAAACAATGTTGAAGACCTTGGCGAAGCA<br>ACGGAGGTTATATCGACTTAGAACGCTGAAGAGTGCTGGAGAATATAGGTAA<br>AGGATTGCCCAAATCGACTTAGAACGCTGAAGAGTGCTGGAGAATATAGGTAA |

TABLE 29-continued

| Locus | | Sequences |
|---|---|---|
| TniQ | Protein (SEQ ID NO: 887) | MSSKEAQAVAQELGDIQPNDARLQTEIQRLNRKSFVPLEQVKILHDWLDGKRQARQGCRVVGESRTG KTIACDAYRLRHKPIQEPGKPPIVPVVYILVPPDCGSKDLFRLIIEYLKYQMTKGTVAEIRERTRRVLKG CGVEMLIIDEADRLKPNTFKDVRDIGEDLGITVVLVGTDRLDAVIKPDSQVYNRFRACHRFGNLSGDS FKRTVEIWEKKVLQLPVASNLSSKTMLKTLGEATGGYIGLLDMLRETAIRCLKKGLPKIDLETLKEVA GEYR |
| | DNA (SEQ ID NO: 888) | ATGAAAGCTACAGACATTCAGCCTTGGCTATTCGAGTAGAACCCTATGGAGGAGAAGTTTGAG TCATTTTTTGGGGAGGTTTCGACAGGACAAATGACTTAAGCGCTACTGGGTTAGGTAAGGCAGTAG GAGTTGGGGGAGCGATCGCACGTTGGAGCCAGGAAATCGAAATGGAG TTGGAGAAGTTGATGATGTGGTAAAGATTGATGAGTAGATGATTAAGAGATGTTACCACCACC AGAAATTGGGATGGAAGATGAATCCGATTCGCCTTCGTGTGGGGCGTGTTGTGGAGAAATGCTCTGTC ATAAGATTGAGTGGCAGTTGAAGACAACGAAGTTTGTAGCAGGACATGGCTAACTTTGCTGTCG GAATGTCCTACTTGTGGGTCGAGAATTTCCGGCCTTGTGGAATGGATGGTGTAAGCG GTGTTTTTGCCGTTGGGAAATGTGCAGTATCAAAATTAGTCAAAAGTCATAG |
| Cas12k | Protein (SEQ ID NO: 889) | MKATDIQPWLFRVEPYEGESLSHFLGRFRRANDLTPTGLKAVGVGGAIARWEKFRNPPPSEMELEK LAQVVKIDVSRLREMLPPPEIGMKMNPIRLCGACCGEMLCHKIEWQLKTTKFCSKHGLTLLSECPTCG SRFAPPALWNEGWCKRCFLPFGEMVQYQKIAQKS |
| | DNA (SEQ ID NO: 890) | ATGTGTACAATTAAATGCATGAGCCAAATCAGTGCCGCTTTATCTCATCTGAATCTACA CGCCACCGAATCTGGGAATCTGAGTTGATGCGAGAGAAAAACACGCCTCTGATTAATGAATGCTAGAACA AGTTGGTCAGCATCCTGAGTTGCAGAGCTTGGCGACCAAAAGGGCAAACTTCCATCTGGGATTGTCA GTAAACTGTGTCAGCCGCTCAAAAAAGAGGAGCGCTTCATTGGTCAGCCCAGTCGTTTGTATATA TCAGCCATTCATGTTGTGGACTACATCTACAAGTCTTGGCTGGCTTTGCAGCTAAGGTTACAGCGA AAATTAGAGGGACAAACTCCTGGCTAGAGATGCTCAAAGTGATTCTGAACTAATCGAAGTAA CTGGTTGCAGCTTAGATGCTTATCGCACCCGTGCCACGTCAAACTCAAGACAAAAAATTGCTCAATCGCTCTCAAT TAACACTAGCCTCAGTAATACATTATTTCGAACATGTCAAAGTGAACACAGAGACATCCTGACTCGCT CCTACACTAGCCTCAGTAATACATTATTTGCTCAAAAACGGTTGCAAAGTGCAAAGTGAGCGACAAGGAAGAAGACGCAGAACA ATTTGCCAAGCGTCGCCGTAAAGTTGAAATTCGCGTTGAACAGCTCTTCAAGAGAGCAGCTGAAAAGCC GGATGCCCAAAGGTCGGGACTTGAAGCGATCACTGGCTGGAGACATTAGTGATCGCTACCAT AATGTCCCCTAAAAATGGGAACTGCAACAGCTAAATCTTGGCAGCCAGCCTTTTGAGAAATCTAGTTC TGTGCCATTCCTCAGTTTACGAACTTACACAGACACTTAACTTGGTCAAAAACCAGAGAAGGTC GTATCTGTGTTAATTTCAGTGGCTTAAGGGCAACATACCTTTGAAATATATTGTGATTCGCGCCAAC TTCACTGGTTCAAACGCTTTCAACCCCTCCTGCCCCGAATTTGACCAGTTGACACAGTGAACAAATGAGGAA AGCAGTTTGTTTACCCTCCAGCCATTAACTTTCTACTGACCAGTTGACAAGAAGGGCGAACC CTGGAACGTCCACAGATTAACTTTCTACTGACCAGTTGACACCGAATTGACAAATGAGGGAA CAGAACAGTGCCCGAAGAGAATCAGCAAGCATTTGAGATCGCTAGAACTCTGACTCGGATGAAAGAAAA GGGTGACATAAACAAAAAATCAGCAGCCTTTTGTCAACAGCCAAGCATTCTACCTTGGCTCGAATTA ATAATCCCTACCCTCGAATCGACCTAGCCAGGCCCCCTTTACAAGCCGGCAATCTCACATTCTGGTTGGTGTCA GTCTTGGTCTCTGATAATCCTGACACAGTAGCCGTAGTACAGGCTACTACACGGTGAAGTTTTCACAT ACCAGAGTATTCGACAGTTACTTGGTGACAGTTACAAATTACAAATTTGACCGCCAACCGAAACAACAG CAAAGTAAATCTCACCAACGTCATAAAGCTCAAAAGTGCTGCGCCAACTCGTTTGGGAATC AGAGCTAGGGCAGCATCGTTCTACATATAGGACGATTGCTTGCTAAAGCAATTGCGATCGCTCAAACTTATC AAGCTAGCACGATCGTTCTACATAAAATGGGCAGTATGCGGAGATTGTTCAAGCGAAATTCAA GCCAGAGCAGAAAGCTAAATGGAGCTACGGCAGATGATTGATTGAGAGCATTCAGAGCCAAGCAGCAAAAC GTAGTGTTCACAAATGGAGCTACGGCAGATGATTGATTGAGAGCATTCAGAGCCAAGCAGCAAAAC TGGAATTGCCATTGAAGAAGGGCAGCAACCTGATTGAGCCAGCCCACAAGAGCAAAGCACGGAG TTGCGCATCATAGCCTATAAGTCCGCAAGTTGCTATAA |
| | Protein (SEQ ID NO: 891) | MCTIKCMSQITIQCRFISSESTRHRIWELMAEKNTPLINELLEQVGQHPEFETWRQKGKLPSGIVSKLCQ PLKKEERFIGQPSRLYISAIHVDYIYKSWLALQLRLQRKLEGQTRWLEMLKSDSELIEVTGCSLDAIRT RAAEILAQSASQSDPVTRQQTQDKKKKFKAKNSNTLSLSNTLFEIYRNTEDILTRSYISYLLKNGCKVS DKEEDAEKFAKRRRKVEIRVERLQEQLKSRMPKGRDLTSDHWLETLVIATHNVPKNEDEAKSWQASL LRKSSSVPFFLVYETNDLTWFKNQKGRICVNFSGLSEHTFEIYCDSRQLHWFKRFLEDQQIKHDSKNQ |

TABLE 29-continued

| Locus | | Sequences |
|---|---|---|
| | | HSSSLFTLRSARLNWQEGEGKGEPMNVHRLTFYCTVDTRLWTNEGTEQVREEKAPEIARTLTRMKEK<br>GDINKNQQAFVKRHSTLARINNPYPRPSQPLYKGQSHLLVGVSLGLDKPATVAVVDATTGEVFTYQS<br>IRQLLGDNYKLLNERKQQQSKSHQRHKAQKSAAPNSFGESELGQYVDRLLAKAIVAIAQTYQASSIV<br>LPKIGDMREIVQSEIQARAEAKCSVIEGQKKYAKQYRCSVHKWSYGRLIESIQSQAAKTGIAIEEGQQPI<br>RGSPQEQARLAIIAYKSRKLL |
| NKFP01000006.1 | TnsB | |
| | DNA<br>(SEQ ID<br>NO: 892) | ATGGCTGCTCAACCAGAGGAAAATAATCAAGTCCCTGAGTCGTTAGATTCGATTCGCAGGAAAA<br>AACGCAGGAGCACCCTCCTTCCTGCTCAACGAGATTTCACCAGAACTGCAACGAAAGATTGATC<br>TGATTGATGCGGTAATGCAGGCTTCAATAAGAAGGCTGCCAGAGCGATCGCCAGGCGAC<br>CCAGGAGCTAGGGCTAACAGAGCGCACAATTCGGGGTCTAGTTCGCGTGTCGAAAGCGGTGAA<br>GGACCCGCCGTGCTTGCAGTGGGTCGTCAAGACAAAGGGCAGTTTCGCATTGCAGAACATTGGTT<br>CAAGTTTATTATTGCCACCTACGAATGGGACAAGTTAGGTGACAAGTTGCAGGCGAATAAGCATCAGG<br>TTCACAGGAAGCTGGGAACATTAGCACAAGTAGGTGACAAGTTGCAGGCGAATAACCATCCATGTCA<br>GCTATTCATGGGTCATCGCAAGGCACGTGAAGACTTAGTTGCAGGCGAATAACCATCCATGTCT<br>CTGTCTATAAAGTCATTGATTTCTACCTGAAGGGAAAGCACAAGAAGTTCCGTCACCTGGCTCT<br>CCGGCAGAAGGACAAATCATTCAAACAGAAGTTAGATATTCTGGTAGTCGACAGAAGGGTGACAGATATTA<br>TTGGCAGTGCGATCACACCAAGTTAGATATTCTGGTAGTCGACAGAAGGGTGACAGATATTA<br>GAAATTGACGACGACGCGGCGAAGAGGTCTGGGGACACGCCCTTACTTGACTCTGATTGCAGACAGCTA<br>CTCCGGTGTGTCGTCGCGCTTTCATCTTGGGCTAGAACCCGCAGGCTCCCATGAAGTGGGTCTTGC<br>GCTACGCCCACGCAATGCTGCCACAGAGTATGGACCGGAGTACGACTTGAGGAGGAGGAGATT<br>GTTTTTGGGAAACCAGAGTACTGGCTAACGATCGCCAAAGGAGTTCAAATCCAACCATCTTCA<br>ACAAATCTCAATGCAGTCGGTTTGAAACTGACCGCGGCTACGAGTGTATCGCTGTTGCCAGGCTAGCACCGGGTCT<br>TCGAGACGATCTTTGACACCCTGAATAAGGAATTGTATCGCTGTTGCCAGGCTAGCACCGGGTCT<br>AATGTTCAAGATCGTCTAAAGATGCAGAAAAATATGCCTGCATCACGCTTAAAGAGCTTGAGAA<br>GCTTTTAGTACGGTACTTTTTCAACTACTTACCACTGGCTGGACTACCCCAGAGTCGAGGTCAAAA<br>GCGACATGAACGTTGGCGTTCCATGTGCGTTCAGAACCAGAAGTTTAGACGAGCGGAGTCTGG<br>ACGTTTGCTTGATGAAAGTTTCTCACCGTAAGGTCGAAAAGTACGGCAGCGTTGAGTTTGCCCGT<br>CTGATCTATCAGGGTGACTGTTTTAATTCCTATCAGGGTGAGGAAATCTCTGCGATATGACGAG<br>CGGAACATCACCGGCTCTGATTGAAGCAAGACCAAATTCCTGCTAGAGAACTGGCCTGGTACAAC<br>CGTTGTTCGTGCGCGTAATTGAAGCAAGACCAAATTTCCTGCTAGAGAACTGGCTGGTACAAAC<br>GGAAACTGCCTAAGCGCGGTGTGAAGAGTTGATCATGATTCGATCCTCGCCGAACGTATGGGACTG<br>TATGAATTTATTGATGAAGAACGCCTCCACAGTGGTTGAGCTTTTCCCTGAGAACCAGTCGGTTGAGACG<br>ATCAGCAGCAAACGAACGCCTCCACAGTGGTTGAGCTTTTCCCTGAGAACCAGTCGGTTGAGACG<br>CCTCCAGATTCTCAACCCGACGCGAAGCCTTTGTCAGCGAGTCCCAAACTGAGGACAGGACGAA<br>CCCTCCTCCACCATCGCAGTCAGTTCCTGAGCCATTGCCCCGGTTGACCGTCCAGACAGTACAGT<br>TGCCGACCTGGTGGGGCTGAAGATGCCTCCGTGGTGATTGTGACGAGGTGTCAACGCTGACG<br>AATCCTCTGATGACTCCTCTTTGTCATAATACTGTAGACTTTTCTCATGAGCCAGTCGTTGCTTACGA<br>TTGGGACCAACTTCTAGCAGATAACTGGTAA |
| | Protein<br>(SEQ ID<br>NO: 893) | MAAQPEENNQVPESLDSDSQEKTQEHPPLLLNEISPELQRKIDLIDAVMQASNKKARQEAIARAAQEL<br>GLTERTIRGLVRRVESGEGPAVLAVGRDQKGQFRIAEHWNFKFIIATYEWGQKQGSRMNKHQVHRKLG<br>TLAKIGEKLRDKRYRKLFMGHRKAREDLVAGEYPSHVTVYKVIDFYLKGKHKKVRHPGSPAEGQIIQ<br>TTEGILEITHSNQIWQCDHTKLDLILVVDEKGDTILEIDDDGEEVWGRPYLTLIADSYSGCVVGFHLGLE<br>PAGSHEVGLALRHAMLPKQYGPEYELEEKEIVFGKPEYWLTDRAKEFKSNHLQQISMQVGFKRRLRA<br>FPQAGGLIEFIFDTLNKELLSLLPGYTGSNVQDRPKDAEKYACITLKELEKLLVRYFNTYNMWLDYPRV<br>EGQKRHERWRSMLLSEPEVLDERSIDVCLMKVSHRKVEKYGSVEFARLIYQGDCLIPYQGEEISLRYD<br>ERNITALLAYTRPAGGQPQGYIGVVRARDLKQDQISLEELRWYKRKLRKRGVKVDHDSIVAERMGLY<br>EFIDEKRKSKRQRRKQANQHQQQTNASTVVELFPQNQSVETPPDSQPDAEAFVSESQTEDRTNPPPPS<br>QSVPEPLPVDAPDSTVADLVGAEDASVVIVDEVSTPDESSDDSSLSNTVDFSHEPVVAYDWDQLLAD<br>NW |

TABLE 29-continued

| Locus | | Sequences |
|---|---|---|
| TnsC | DNA (SEQ ID NO: 894) | ATGGCTCAACCTGCTCCACACCCAAGCGACAATCGACACCAGTCCCAGCCAGTCCGCCACTAA GCCAGCGCCACAACAATCTGTCCTGGCATTGCCCAAGCGATCCCCAGAAACCAGGCTGAAGTTG AGCGAATTCGGGACAGCGGAGACTTACAAAGAGGTTTCTCGTGATCAACTTTTGTTAAGTGGTTG TCGTCACAGCAGGAATCGCGTGCCAGTGGCTTTGTGTACGGAGTCAATTTGGAGATCTGAGGAA ATCCTGCCAATTTTATCAACTGCTATACGTGCGAAACGGGAAACCTGTTTCTGCACCTCCACAC AGTTCTCTATGCTGAGGTTGAACAGTTTGGTTCCCCGACTGACCTTTTATTGGAATCACTCAGGC AGGAGGCAATCCCTTCTCAGGTATGGGATCGTTACGAGATTTGAGGAAACAGGCGGTCGGCACAC TTAAAAAACTTCAAACCAGCACACCTGATTATTGGCTATGCAGAAGTTTTGTCCCCTGAGGCGTC AAAGAACTTCTAAAAATGAGCGAGATTAAAAATCTCTATTATTCTTGCGGGTTCTATGTCTTA TCTGAGTGCTTTTGACAAGCTCGATAAGCAGCGTGGTCCAAAACACAAGGACATTAGAAACGCTTT TCTGAGTCCACCAATACCCTGCTTCGAGAAGAATGAGACAGAAGCCATTCTGCTGTTCCTAACT TCCTCTACACTCGCTGTGCGACAGCTGAACCGCTGTACGAGATGCTCCGCAAGATAGCGATC CAAACGTTGGACGATCCAAAGCTGCAAATTAGTACAACCACTCTCACAGAGCTATTTGCAGCAAG GCGGGTAGCGGTAAGCACGTAG |
| | Protein (SEQ ID NO: 895) | MAQPAPQHAQSQPVPSQSATKPAPQQSVLALPKRSPENQAEVERIRDSETYKEVSRDQLLFKWLSSQ QESRASGFVYGVNFGDLRKSCQFYQLLVRKRGNLFLTPTPVLYAEVEQFGSPTDLFIGITQAGGNPFS GMGSLRDLRKQAVGTLKKLQTSTLIIGYAEVLSPEALKELVKMRPDLKISIILAGSMCLSEFFDKLDKQ RGPHKDIRNAFLESHQYPCFEKNETEAILEGWENQVLSSWSKKLDLKKIPGVPNFLYTRCGGQAEPL YEMLRKIAIQTLDDPKLQISTTTLTELFAARRVAVST |
| TniQ | DNA (SEQ ID NO: 896) | ATGGTTGATGAGACAGAAGAATTTGAACTACCACGCTGGTCTCCAGAACCTTTTGAAGGCGA GAGTATCGGCAGTTATCTGTGCCGGTTTCAATCGCAAGAATTAGCTCCATGTCTATCGGTAG TTTGAGTAGAGCACTAAGCTGGGCCACAACGTTAGGAGACATGGGAAAAGCTTCGCTTCAATCCTT CTCCCAGCATGGAGGAAATAGAGATCTTCTGTAACTACATAGGGCTGGCGTAGAAAAACTCATT CCAACCTTTCCGGCAAAAGGGCGAAGGACGACGCCGAATTCGATTCTGTGCTTCCTGCTA CGCAGAAGCCACCTTATCACAGACTGGAGTGCAGGATAAAGGACGATCGCCAATTGTCCCAAGCAT CAAGAACCTTTGCTCCATCAATGTCCAGGTTTGTGAAAGACCGTTCTCGATTCCTGAGCTACTCCAG GGTGACCAATGTAAGTGTGCCTTGTACTTCAGACGAGCGAATGCGTGAACACCGAGAGCGGTTCCAAAG GAGAAAGCTTGCTAAGAGGCTCAAGCTCATTAA |
| | Protein (SEQ ID NO: 897) | MVDETDEEFELPRWCPEPFEGESIGSYLVRFRSQEISSMSTIGSLSRALKLGTTLGRWEKLRFNPSPSME EIEIPCNYIGLAVEKLIPTPPAKGRRTTPEPIRFCASCYAEATYHRLEWQDKAIANCPKHQEPLLHQCPG CERPFSIPELLQGDQCKCGLYFRMAEHRERFQRRKLAKRLNRQTH |
| Cas12k | DNA (SEQ ID NO: 898) | ATGAGGACAATTACATTTCGACTCTGCCGCCAGTGAAGAAACACCGCAAGATTTCTGGTACCCTG CCAAGAACATACCCCTCTTCTTGTCAATGCTCTCTTTCTCATAAAGTACAACAGAGTAAGAGTTCAGA CTTGGCAAGAAGACAGCCTTTCAATTCGGGCTAACCAGACAGACGTGGGATCTTGGATTGCACAGCAAAGGAGG AGAAAAGACAGCCTTTCAAGTCCAAGTACTAGACAAAGAGGGACCAAACAAAGTTGCCAGACTACCTTCCAGAT TCATTGCCTCTGCAATTCGGGCTAACCAGCAGACGTGGGATCTTGGATTGCACAGCAAAGGAGG CGTTATATGAGCGATCTGTAAACAGGACTGCAGTTGCAGTGACGATCTTGATTTGTC ACAGACGACCGATTTTACGTTTGCTCAAATTTGTACTGAAGTGCCAGAGGTGCTGGCAAGCGTCA CAGCACAAATCGCCGCAGGAGGACAAGGACAAAAGTATCCGAATCCCCGCATTACAGAGGC TCTCTTCAAATTGCTTAAAAGAAGCAGAAGCGCTAACTATGCGTGCAATAGCGTATTTGTTGC GGAACAATGCAACTGTGCAGGAGGACGAAGAATCCTCAAGAAATTGCACTGAAACTAGACCA GAAGCGGATCGAGATTGAGCGACTCAAAATCAGTTGCAAAGTCAATTTCCTAAACCGCGTGATC CTACGGGTGCAATTGCGGATCGTGTTCGTGCTGATAACTAACCAGGAGCTTCCTGGACTCAGTCTGCAA TGGAAAAATCTTGGTACTGTTCTGCTGATGCCAGCTGTAATAGCGTCGGGATGCTGCGAGCAAGTGA TTTCACAGTCATCATCTACTTCAACACTGCAACATCCGATTTATCAAGAGAGCACAGCAGCAG GTTCAAGTCTTGGAGAGGGCTGCTTGAGCAGTGACGATCTCTACTGGTCAGTGAGCCAAAGCACAG AAGCTGTTGAACCCAAGGAGACAACACCTGCGCTACTGACGGTCAACCCCGGCGATCGCCAA AACGAAAACGCAAAATCGCCAGAATTCAGGTTCAAGAGCGGATCGTGTTAGCTTTTAAGGG |

TABLE 29-continued

| Locus | | Sequences |
|---|---|---|
| | | GCTAAGAGAACACAAGTTTGTGTCAGTGCAGCCATCGTGATCTCGCAATTCTTCAGCAGTGCC<br>AGCGTGAGTGGGAAAGATATGGGTCATTGCCGGACGACAAGAAGTTTAGTTAGGACTCTTCCG<br>GCACGAGCGGCACGTCTCTCTGCGTAAGGATAAGCAGCAGCGTAAACCCTGTCTAACTCACC<br>TGGTTGAGAAGTCACAGGTTGAAGAATGGCGAACTCGGCTTCTACCTGCCACATCACGATCGATG<br>ATAGTTACTCTCTGCTGAGGAACGCGAAAGCGCAAGTCACCTCGCAGGAAGCTTGAGGAAGCGAGGA<br>TGACCAGAAAACGATGCGAAAGCGCAAGTCACCTCGCAGGAAGCTTGAGGAAGCGAGTTAACC<br>CAGGAACAGAAAGATGCGAAAGAAGAGGCTAAGGATGGTGCCATTGCCAAAAACGAGTAGCTTCAACGC<br>AAGCTCGTTTAAGCGATCCTACCAGATTAAAGCTCCCAGTGCGAAAGCCTATCAGGGCAGTCT<br>CATATTCAGTACGCGTATGTTTTAACCAGCAGGACGGTGTTGCTGTCTGTCTGTGATACTCAG<br>CAGCAGCAGGTCTTAGAGTATGTGAGCGTGCGAGATTTGCTGTACGACCACAGTGCCGAGAAACA<br>TCATCAGCACTTCATCAGTAACCCAAAGCTAAAGGTAAGCGCACGCTTGAGCAAATGCCAACTGG<br>AGCAGTACCACCTGCTCGATCGCTTAAGGAACAGCAGTCAAAAATCCACCAACGCGATGCG<br>GGCACAAAAGCAGGGTTACTACAATACAGAATCGAATTCTGTTGACGAGTACCTAGAT<br>CGTCTTTAGCTGCCCGTATTGGTCAACTCGCTGTTCAGTGCAAAGTTGCAAGCTAGCTCAGTCGTCATTCCA<br>GATTTAGGGAATCTCCGCGAGAGCGTTGAGGCAAGTTGCAAGCCTGGGCAGATCTAATTTTTCC<br>CAAAATGGAGAAGTTCAACAAAGACAACAACCAAAAAAAATCCGCTGCAGTTTTCATGGCTGGAGC<br>TATGTCGATTAGCACGCTGTATTCGCGAGCCGCTCGTGACGGCTGTGATCGTGATCG<br>TCAGCAGCCACACAGGGAAGTTTCAAGAAGAACAAGACAGTAGCACCTGCCAATTCGACA<br>ACAGCCTGA |
| | Protein<br>(SEQ ID<br>NO: 899) | MRTTTFRLCASEETRKIFWVLCQEHTLLVNALSHKVQQSKEFQTWQEKGWLPNKKLKLLNKEVLEEK<br>TAFQVQVLDQTKLPDLPSRFIASAIRANQQTWGSWIAQQRRRYMSLTGKQDWLQLQECDLDLSQTTD<br>FTFAQICTEVREVLASVTAQIAAEEQKKQNQKKRSRQTTKAKRTVKKQKKVSESRRITEALFKLLKKK<br>QNALTMRAIAYLLRNNATVQEDEENPQEIALKLDQKRIEIERLKTQLQSQPPKPRDPTGAIADRYINEA<br>LEKPSFATSWKILVLFCLLITNQELPGLSLQFHSHLLQQLQHPDLSREAQQAEFKSWEEGCLERMTKLA<br>TVLKSLPLPISFDSSDDLYWSVEPKQQKAVEPKETTPAPTDGQPPRSPRKRKNRRKIQVQERIVVRFK<br>GLREHKFGVQCSHRDLAIILQQCQRRMERYGSLPDDKKFSLGLFPARAARLLWRKDKQQKPSANSPG<br>EKSQVEEMWRQYRLYLHITIDDRLLSAEGTEEVRQEKLIKAQDDQKTMRKRKSPRKKLEEAELTQEQKE<br>KKAKDGAIAKKRVASTQARLSDPTRLKRPSRKPYQGQSHIQVRVCFNQQERVSLAVFDTQQQQVLEY<br>VSVRDLLYDHSAEKHHQHFISNPKRKGKRTLEQMQLEQYHLLDRLRKQQVKNHQRRMRAQKQGYY<br>KYSKSESNLGEYLDRLLAARIGQLAVQWQASSVVIPDLGNLRESVEAKLQAWADLIFPKMEEVQQKT<br>TKKIRVSFHGWSYGRLARCIRSRAARDGLAIVIGQQPQQGSLQEKARAVAPANSTTA |
| PVWK01000017.1 | TnsB | |
| | DNA<br>(SEQ ID<br>NO: 900) | ATGATGTCTACCGAAGACGATGCCGAACAGTCAGAAGTCGTTGATGAGCCTTCAGAAACACTAGC<br>ACTTGATGCCAGCACTTGTTGCGATTGGTCAGTTGTAAACAACCCTGCTTGAGAATCTAGATAAACATA<br>CATCAAGGTTTGCTTAGCTCAGTGGGTAGCTAATTCTCCCAATCGCGATATTTTTCTTCAAAGGA<br>AGCAAGAGATCGCCGACACATTGAGCTTTCCATGCGGCAGGTGGAACGAATTTAAGAGTTAT<br>CACAAAAGTGAATTAAAGGAACTCTGAGAATCAGATAAGGGTGAGTACAAAATCT<br>TGCCTTACTGGGTTGACTACATTAGAGTGGTTCTACGATGCAGGATTGAGAAAAGGTTGTCTATAT<br>CTCGTGCTGATGTGTCAGAGAAGTAGAACGACACGCAGAAATTGACCTACAACTTCAGCCAGGT<br>GAATACCCGCATCGTGCTTCGGTTTATCGTGTTTAGCCCCGTGTTGTAGCACGTGCGGCTTTACAA<br>AAGAAAATTAGGAACCCCCGTTCAGGTTCAGGTTTATCTAAAACCCGTGATGGCGAATTCAT<br>CAAAATTTTCTAGCAACCAGTTATTCAGTGTATCACACAAAACTAGATATCCTTATTGTTGA<br>CAAAGATGGCAAAGTTCTTGGACTCGTCCTTGGCTGACAATTGTAGTGGTAGACCTTGGATAGCGCTTCTCTAGCTGCCGT<br>TTTAGGGTTTTTCTTGACTACCCCGACGACTATGAACTGTCGAAAGACCAAAGCCACATTCAACAGATC<br>AGCTTTACCTAAACATTACCCCGACGACTATGAACTGTCGAAAGACCAAAGCACATTCAACAGATC<br>CGCTCCAGTACTTTTTCACAGATGGTGGAAAAGACTTGTCATGATGCACAAACAACAACTAGATATCCTTATTGTTGA<br>GGCAGGAATTTCAACTTTAAGTGCCAGTTACGCTTTAAGCCTCCTCAAGGTGCATTGTGAGAACG<br>CGTTTTTAAGACCATTAATAGTAAAGTGCTTCAGGGGCTTCCAGGCTACCGGGTTCTGTGTTGA<br>AGATGCGTCCAAAACACGCCAGAGAACCGCCTGTCTAACCTGGAGGATGTTAAGAAATCTTG<br>ACCGGGTTCTTCTGCGATAGCTATAATAACCACGACAAACATCCTAAGAAAGGTATGACAAGGTA<br>TGAATACTGGTTAGAGGGATTGGGGACCTTACCAGACCTATTGATGAGCAAGAATTAGAATC |

TABLE 29-continued

| Locus | | Sequences |
|---|---|---|
| | | TTTGCTTGATGAAAGCAGCATACCGCTCTGTTCAAGCCCACGGTTCAGTAAATTTGAAAATGTTA |
| | | CCTACAGGAGCGAAGAGCTTAAAAATCACTTGGGGAGCGAGTAACGCTGAGATATGATCCCGA |
| | | CCATATTCTAAGCCTTCGAGCTTATACCTATGAAGCGGATGAAGCGATGAAAAATGGAGAGTTAATTGACG |
| | | ATAATGTGAAAGCTCTCAATCTAGAATATCAGGCTCTGACTTTGGATGAATTGAAGCAAATTAAT |
| | | GCAAAGTTGACTGAGGAAGGTAAAGAAATTGATAACTATACGATTCTTCAGGAACTGGGGCGTA |
| | | GAACCGAAATGGTTGATGAGGCAATTCAGAACCGAAACGATCCAGAAGAGCAGCACACAAAGA |
| | | GGCTCGAAGTGAGCATAAAGATAACTCACCAAACCTGGCTGAAGCAGAATTAACAGCCCCAAGTGC |
| | | TCAGTCACCCTCCGTGGAAGCGTACCTCCCAGCTTGGCTGAAGCAGAATTAACAGCCCCAAGTGC |
| | | ACCTGAAGCGAAGAGAGTGACATTTCCGCTAGCACGCTAGAGCTTTTACAGCTTCCTGATAAGC |
| | | CTGACGGGACGGTTTCTATCCTCTTTCCGACGATGGCAGTGCCGAAATCGTTCAGACAGAAATC |
| | | GCTCAAGCGTCAGTTGTCGAGCAGAGTTTGGCAGCGATCGTGACTCCTCTAGCTGAAAAGCTAC |
| | | TACGGAAGCAGTCATTACGCCTCAAGTCGAATCCCCAAACAGAGAGGTGCTACGATTTCATTA |
| | | TTTCAAAACGTTCGCGCCGAAGTCGATAG |
| Protein (SEQ ID NO: 901) | | MMSTEDDREQSEVVDEPSETLALDASNFVADCKQTLLENLDKHTSRFALAQWVANSPNRDIFLQRKQ |
| | | EIADTLELSMRQVERILKSYHKSELKETSGTERSDKGEYKILPYWVDYIRWFYDDRIEKRLSISRADVV |
| | | REVERHAEIDLQLQPGEYPHRASVYRVLAPVVARAALQKKIRNPGSGSWFYLKTRDGEFIKIFCSNQVI |
| | | QCDHTKLDILIVDKDGKVLGRPWLTIVVDSFSSCVLGFFLGLKQPGTEEVALALRHAALPKHYPDDYE |
| | | LLRPWDVNGLPLQYFFTDGGKDLSKAKHIQQIGRNFNFKCELRFNPPQGGIVERVFKTINSKVLQGLPG |
| | | YTGSCVEDRPKHABETACLTWRDVKKILTGFFCDSYNHDKHPKKKGMTRYEYWLEGLGTLPEPIDE |
| | | QELDLCLMKAAYRSVQAHGSVNFENVTYRSEELKNHLGERVTLRYDPPDHILSLRAYTYEADEKMGE |
| | | LIDDNVKALNLEYQALTLDELKQINAKLTEEGKEIDNYTILQELGRRTEMVDEAIQNRNDRRRAAHKE |
| | | ARSEHKDNSTKPGSRKTTKKASVTLRGSVPPSLABAELTAPSAPAEESDISASTLELLQLPDKPDGTVF |
| | | YPLSDDGSAEIVQTEIAQASVVEQSLAAIVTPLAEKATEAVITPQVESPKQKECYDFIISKRSRRSR |
| DNA (SEQ ID NO: 902) | TnsC | ATGTTAGAGTCCAACTTGGTTTCACAGCCTATCGTAGAGATCTTAGCTTCGTTGGCAGACACGAG |
| | | AGTTAAGGTGTCCGCCTTGACAAAGACTACTCAACAATGGCTATATACCAACAGATGCTGCTGAGT |
| | | CTGCGATCAATTGACGTGAAAGTCGGCTGCTGTGAGGAATATGAAGATCGGTCGCTTGTGCTCACGT |
| | | GGAAGTGGTAAAGTCGGCTGTGAGGAATATGAAGATCGAGATTTTGACCGGCTATTCGGGT |
| | | AAAGCTCCTACGGGATGTTCTTCTAAGCAAGTTCATAGATTAATCTTAAAGCAATGAACCATG |
| | | CGGCAAAGATCAGGCGGCGTGATGATACGCCAGAAGCAATGAGTAGTCCAGAAGCATTCTTGATCTTAAAG |
| | | AATTGAGGTAATCCTTATTGATAACGCCAGAAATTTGGCAGTAGAAGCATTCTTGATCTTAAAG |
| | | ATCTTTACGATGAGAAAAGGTAACTATCATTTTCCTCCGCACACCTGATTTAGATGTTTCGCTGG |
| | | AGCAAGTTGGCTGTGAACAGTTTCCCTTACTCTTATCCTCTAGGTTCTTCTTGTCCGAAGCTGATTT |
| | | TAAGAAAGTTTTGACACGATCGAAGCAAAAGCACTGAATCTTCCCTTTGAATCGAAGTTAAGTG |
| | | AGGGAGAGAAATTTGAGCTCTTAACGACATGCACCAGGTAGTTTGATTGGAAGGCTGATGAAGCTT |
| | | CTACCGACAGCAATTTATATTCTGTTCAACACATATCTTGAAGCGCTTAAGAACAGATTCAGTGAGTC |
| | | ACAGCCTATGTATAAGCTGGATAGCATATCTTGAAGCGCTTAGAAGAATTCAGTAGGGTACG |
| | | GGGTAAAAGTTCCGTTTGAGAAATCTAGTTCAAAGTAA |
| Protein (SEQ ID NO: 903) | | MLESNLVSQPIVEILASLADTRVKVSALERLLNNGYIPTDAAESAINWMDERRFLKQCCRLVAPRGSG |
| | | KSRLCEEYEDRDFDFVIRVKAPTGCSSKQVHRLLIKAMNHAAKIRRRDDPRAMVVESVMPFEIEVILID |
| | | NAQNLAVEAFSDLKDLYDEKKVTIIFSGTPDLDVSLEQVGLLESFPYSYPLGSLSEADFKKVLDTIEAK |
| | | ALNLPFESKLJSEGEKFELLTTCTGSLIGRLMKLLPTAILYSVQKVSEQEADQTESQPMYKLDSISLEALR |
| | | KIAVGYGVKVPFGKSSSK |

TABLE 29-continued

| Locus | | Sequences |
|---|---|---|
| TniQ | DNA (SEQ ID NO: 904) | ATGACCAGCAAGCTTAGTAAATACCCCAGATTGCCACCCCTTGAGCCTTACTCAGGCGAAAGCCT ACCACATTATCTTGGTAGATTTCGACGCTAAAAGCACCGGAGCGAGCCCTCTCCAAGTGCGTTGG GACAAATGGTGGGATTGGTGCGGTTGTGCCTCAATGGAACAGGGGTATTTCAACCCTTTTCCA ACAGTGAGCAGCTTCTACTTTAGGGACGTTAGATTCAAGACCAGTCATCGGTTTAGACATAGATACATTAACCCGGAT GCTGCAACCAAAAGGGTACGTTAGATTCAAGACCAATTCGTTTATGTGAGCTGTGTTACGCCG AGCACCCTTGTCACCGGATTAAGTGGCAGTTCAAATCCAAATTGAGTCCAAGGTGCGATCACCAC AAGCTCAAACTATTAATGAAATGCCCAGGCTGTGAGCAGCCATTTCCAGTTCCTTCGCTTTGGCTA GAAGGAAAATGCCAAAACGCAAATGCGGCATGCGATACTCAAGAATGCGAAGCATCAGAAGT CCGTGCTTTATTAA |
| | Protein (SEQ ID NO: 905) | MTSKLSKYPRLPPLEPYSGESLPHYLGRFRRLKSTGAPSPSALGQMVGIGAVVAQWEQGYFNPPTVE QLSTLGTVIGLDMDTLTRMLQPKGVTLDSRPIRLCGACYAEHPCHRIKWQFKSKLSPRCDHHKLKLL MKCPGCEQPFPVPSLWLEGKCQNAKCGMRYSRMAKHQKSVLY |
| Cas12k | DNA (SEQ ID NO: 906) | ATGCAGATGCGGACTATTAAAACTGACTCCATAGTCAGAATCACCCAGCGTCGTAAAAGGAAGG GAGTCACAGAGGACCTGCCCCTCGTTTGATGAAGCAGCCTGTGCCGTTTATGTGAATTTAGCTAT AAACATACGCTGCTGGTCGATACGATCGTTAGCCAGATCAGATCAAACAGCATCATAAGCTCATCAATTG GATACGTAGCAGTCAAGAGCTTCAAAGACAGGATGACACCACTGAGACACAGAAACAGAAGCAGCAG GGGCAAAATGGTTGCCAGAGGGGTTAGTCAAAGCATTGTGATGCTCTAGCAAGCACGCCTCA GTTTAGTAAGATGTCTGGACGCTTCTATACCTGAGACGCTTCAGCTCGATCCGTTGAAGAACTCTTGGCAGTTG CTGGTTTGCTGCTCACCAAAAATTGATCCATAAAATAAGGGAAAACGACGCTGGTTGCAGTTG TTGAAAGTGATGCTGCTTTAGCTGAGACCAGTAATTTAGCCAGCAGGAAATCGAGATAAGAGCT GGCAAATCCTAGCCGAACTAGAAGCTCACAATGGAACGAATGCTGGCAGCAATGATCATGTAG ATTTCAACACCCTATTCCAGAAATTTGACGAGACAGAAGAGACTCTAGCTCGCCGTGCCATTATT CATCTGCTCAAAATGGAGTAAGACCCACGCGGAAGTAAGAAGTCTAGAAAGAGAAGAGA AAGGCGAAAAGCATCTCTACACAGCTCTTAACGCTTACTGAGCGTTGAAGCGCAGCGAGTTGG AATAGAACGTTTGGAAAAGCCAGCTTCTAGGACAGCTTCCAGACCAGAAATCTCTTTCCTGAAC AGGCATTTGAGCACCATCTGAAGGGTAATTGCCAACTCTGCGAACTCAGAGTGCAACGAGTTGAG CGGTATTACTTTTTTGTATTTCTCACTGTTTGCTTTATCTTGCCGATGCCAACGAGTATCTTCAACTTG AGCGCCACTTACTGACAACACTGGTACTTCAATGGAGCAAATTAGGTGATCTCCATTACTATCGA GTTTTGATTTATGCTTTATGCTGCAAACTAAACTTGAGGCAGAGAAGAGTTGAAGCTGCTTCTTTTGGTCTTTATT TACTGCAAACCATCAAACTTGAGGCAGAGAAGAGTTGAAGCTGCTGCTTCTTTCTTGGCATGAGTCA ATCACCACAAAGTTACACGACTTCTTGAGAGAGCCCAAAGCTCTACCCTACCCATTAGTTTTTGC TACGATGATGTCCGATCGTGCAAATGAATCAAAAGGGAAAATTTCTTCAAGTAAATGGTTG GGGTGACTTGCTCTCTTGAGGTAGCCACCATCGTCAGTTGCCGCTGATCAAAACCTTTCTGAA GAGCTGGCAAACTAAAACGCCCCTCGAAAGAAAGCTCAATCTTCAAGAAGAGATCCATTTACA GGGAGCTTGATGCTGCTCCCGTTCATTGAACTGAACTCTGGAAGCTAAAGAAGCCAGCGATCAAAA AGATGCCCAGTTGTCGCTCCACTGCGAGTGTTTCAGCAGTCAGCGAACAAGGGTTCTGGAATG AATGCAAGCTCACGATTCATTGGACTTTTAATGCCGAGGCTCTGACACGTCAGGGTTCAGAAAAG |

TABLE 29-continued

| Locus | | Sequences |
|---|---|---|
| | | ATGCGTCAGCGCAAGCTGGAGCTACAGTTGCAGCAGTTGCAGGCGAAACAGGCAAAGCTGGAAC<br>AGCAGCAAGACCGGCTGGACAAGTTGGAGCAAGCAGCACCAGAAGCTGCCAAGAGCCAAGAGC<br>AACTCAAACGCATTAGGAATCTGAAAAGCAGATTCAGCAGCTTCAGGAAGATCTTGCCAAACTA<br>CGCCCAAAACTAGCTGTCTCCAAGCTGCCCAACCGTTTGGGCGTCCACCCGTTTACGAA<br>GGTGTCCCCAACATCTTTGTTGGTGTCTCCTTGATCTGACACACATCTGCCGCTGACCGTCGTG<br>GATGCGATGCGCCTAAGCGTTTAGCCCTCCGCAGCGCTCCTAAGATTTCATCAGAAGGTTACAG<br>GCTCCTCCAAAAATATTTTCGGCAACGACAGGAACACTCAAAACAACGCAAGAAGATCAGCAA<br>GCACAGCGTATAGCCATGAACTGGCTTAGGTCAACAGGTAGACCGTTTGTTTGCCAA<br>AGGGTTAGTTGAATTAGCACAGGCGTACAAAGCTAGCACGATCGTCATCCGATCAAGGTGGAT<br>GGCGGAGCGATTATATAGCCAGCTAGTTGCCAGAGCCAAACTTAAGTGCAATGGCAACAAACA<br>AGCAGTGGCTCGATACACCAAAGCACATGCGACGGCTGCATCAGTGGATTACAACCGTTTAA<br>GCCAAGCAATCACCGATTGTGCCGCCACCGCATGGTATAGAAGTTGTTTTACAAAAAACTGTGTT<br>GAAACAGATGTGTTTCAACAGCAGCAAACCTTGCACTTGACCAGCTTACGATTCGTTAAATTCTGC<br>TCAAACGTGA |
| Protein<br>(SEQ ID<br>NO: 907) | | MQMRTIKTDSIVRITQRRKRKGVTEDLPSFDEAAWCRLCEFSYKHTLLVDTIVSQIKQHHKLINWIRSS<br>QELQRQDDTTQETEAKQGQNGLPEGLVKALCDALASTPQFSKMSGRFYTSAIDRVEELFKGWFAAHQ<br>KLIHKIRGKRRWLAVVESDAALAETSNFSQQEIEIRAAQILAELEAHNGTNAGSNDHVDFNTLFQKFD<br>ETEETLARRAIIHLLKNGGKTHAEVKKPRKRKGKSISTQPLTLTERLEAQRVGIERLEKQLLGQLPR<br>ARNLFPEQAFEHHLEAVIAMPNSDATELERYYFLYFSLLLYLADANEYLQLERHLLTTLVLQWSKLGD<br>LHYYRVLIYAFMLHAASAQQYLQLGSYLLQTIKLEAERVEAAFFAWHESITPKLHDFLREPKALPYPIS<br>FGYDDVRSWQMNQKGKIFKLNGWDLLFEVRCHRQLPLIKTFLKDWQTKNASERKAQSSKKDPF<br>TGSLMLLRSIELIWKPKEASDQKDAQLCSHCEVFQQSSEQGFWNECKLITIHWTFNAEALTRQGSEKM<br>RQRKLELQLQQLQAKQAKLEQQQDRLDKLEQAAPEAAKSQEQLKRIRNLKKQIQQLQEDLAKLRPKL<br>ACLQAAQPFGRPDRPLYEGVPNIFVGVLLDLDTHLAVTVVDAMRKRLALRSAPKISSEGYRLLQKYF<br>RQRQEHSKQROEDQQAQRYSHQTESGLGQQVDRLFAKGLVELAQAYKASTIVIPIKGGWRERLYSQL<br>VARAKLKCNGNKQAMARYTKAHGERLHQWDYNRLLSQAITDCAATHGIEVVLQKTVFETDVFQQAA<br>NLAIAAYDSLNSAQT |

Example 17

The annotations of an exemplary CAST (System ID T21, *Cuspidothrix issatschenkoi* CHARLIE-1) is shown in FIG. 73, and the sequence is shown in Table 29 below.

TABLE 30

| | |
|---|---|
| Full sequences (SEQ ID NO: 908) | TAACAAAATATTGTCACAAAAAATAAAAATTATTGAAACCCTGCTATAACAAGGATCATAGCAGGGTTTAGTTAT<br>TATACCTTCTAATCATTTTGTGAAACCTTTTTTAACAAATTAATTGTCAAAAAAGGGAAAATTAACAATTTAAGTG<br>TCAATTCCCAAAATCCATGTAAACTACTCTACTTCTGAAAATTTCACACATTAAATGTCACTTTTGATTTATAATA<br>TACAAATATGTTCCAATTAAACATCAATGTATATGAGGAATGAAACACCTATAACTCCAGACAACTTAGAAACTG<br>AAAGTGTTACCGCCAAAGATACTCAAATCATTGTGTCGGAACTTTCCGACGAGGCGAAACTAAAAATGGAGATT<br>ATTCAAAGTTTATTAGAAGCAGGCGATCGCACTACCTATGCTCAAAGACTCAAAGAAGCAGCAGTAAAACTGGG<br>TAAATCAGTACGAACAGTAAGGCGACTGATTGATAAATGGGAACAGGAAGGCTTAGTTGGTCTGACGCAAACTG<br>ACCGGGTTGATAAGGGTAAGCACCGAGTTGATGAAAACTGGCAGGAGTTTATTCTCAAGACTTATAAGGAAGGT<br>AATAAGGGCGGCAAACGCATGACTCGCCAACAAGTAGCAATCAGAGTGAAGGTAAGAGCGGATCAACTAGGTGT<br>CAAGCCTCCCTCTCACATGACTGTTTACCGTATTCTTGAACCTGTGATTGAAAAGCAAGAAAAAGCAAAAAGCAT<br>CCGCACTCCTGGTTGGCGTGGTTCTCGATTATCACTGAAAACTCGTGACGGACTAGATTTATCTGTCGAATACAGC<br>AATCATATCTGGCAATGTGATCATACTCGTGCTGATATTTTACTGGTGGATCAACATGGTGAACTTTTAGCTCGTC<br>CTTGGCTGACAACGGTGATAGATACTTATTCTCGTTGCATCATCGGAATTAATTTAGGTTTTGATGCACCTAGTTC<br>TCAGGTGGTGGCTTTGGCACTGCGTCACGCCATATTACCCAAAAAATATGGAGCAGAATATGGACTACATGAGGA<br>ATGGGGAACTTATGGCAAACCAGAACACTTTTTTACTGATGGTGGTAAGGATTTTCGTTCTAACCATTTACAACA<br>AATAGGTGTGCAGTTAGGCTTTGCTTGCCATCTTCGAGATTGCCCCAGTGAAGGCGGTATTGTCGAACGTCCCTTT<br>GGTACTTTGAACACTGATTTATTTTCTACCTTACCAGGATACACAGGCTCAAATGTGCAGGAACGTCCAGAGGAA<br>GCGGAAAAAGAAGCTTGTTTAACTTTACGAGAATTAGAACGTCTATTGGTAAGGTATCTCGTAGACAAATATAAC<br>CAAAGTATTGATGCTCGTTTGGGTGATCAAACTCGCTATCAAAGATGGGAAGCTGGGTTAATTGTTGCCCCCAAT<br>TTAATCTCTGAGGAGGATTTGCGTATTTGTTTGATGAAGCAAACTCGACGCTCGATTTACAGGGGTGGATATTTGC<br>AATTTGAAAATCTCACCTATCGGGGTGAAAACCTAGCTGGTTATGCTGGGGAAAGCGTGGTGTTGCGATTTGACC<br>CGAAAGACATTACAACTATCTTGGTTTATCGCCAAACAGGTTTTCAAGAGGAATTTTTAGCTCGTGCCTATGCCCA<br>AGATTTGGAGACTGAAGAATTATCTCTGGATGAGGCTAAAGCTATGAGTCGTAGAATTCGCCAAGCAGGTAAAG<br>AAATTAGTAATCGTTCGATTTTGGCTGAGGTAAGAGACAGAGAAACTTTTGTTAAGCAAAAGAAAACGAAGAAG<br>GAACGCCAAAAAGAAGAACAGGTTGGTGGAAAAAGCCAGCAGTGAGCGAAGTCGAACTGCTAAAAAACCTG<br>TGATTGTTGAACCTGAAGAAATAGAAGTGGCATCTGTGGAAAGTTCCTCAGATACAGATATGCCAGAGGTTTTTG<br>ATTATGAACAAATGCGCGAAGATTACGGGTGGTAAATTATGATTTCACAACAAGCTCAAGGTGTTGCTCAAGAAT<br>TAGGTGATATTCTCCCCAATGATGAGAAGTTACAAGCGGAAATTCACCGATTGAATCGGAAGAGTTTTATTCCTT<br>TGGAACAGGTGAAAATGCTCCATGATTGGTTAGATGGTAAGCGACAATCACGGCAGTCTGGGAGGGTGCTAGGA<br>GAGTCAAGAACGGGTAAAACTATGGGTTGTGATGCCTACAGACTCAGGCATAAACCGAAACAAGAACCAGGAAA<br>ACCGCCAACTGTGCCTGTTGCTTATATCCAAATACCTCAAGAGTGTAGTGCTAAGGAGTTATTTGCCGCAATTATT<br>GAGCATTTGAAGTATCAAATGACAAAGGGAACGGTGGCAGAGATTAGAGATAGAACGCTGCGGGTTCTCAAAGG<br>TTGTGGGGTGGAAATGCTGATTATTGATGAGGCTGATCGTTTTAAACCTAAGACTTTTGCGGAGGTGCGGGATAT<br>TTTTGATAAGTTGGAAATTGCGGTGATTTTGGTGGGTACTGATAGATTAGATGCTGTAATCAAACAGATGAGCA<br>GGTTTATAACCGTTTTCGCGCCTGTCATCGGTTTGGTAAGTTTTCTGGGGAAGATTTTAAGCGCACTGTGGAGATT<br>TGGGAAAGGCAAGTTTTAAAACTGCCTGTTGCTTCTAATCTTTCCGGTAAGGCTATGCTGAAGACTTTGGGTGAG<br>GCAACTGGGGGTTATATTGGGTTGCTGGATATGATTCTTAGGGAGTCGGCTATTCGGCTTTAAAGAAGGGATTA<br>TCAAAGATTGATTTGGAAACTTTGAAGGAAGTAACGGCGGAGTATAAGTAATGGAAGTTGGGGAAATTAATCCTT<br>GGTTGTTTCAGGTAGAACCTTTTGAGGGGGAAAGTATCAGTCATTTTTTGGGGCGGTTTCGACGGGCAAATGATTT<br>AACAACTACTGGTTTGGGTAAGGCTGCTGGGGTTGGGGGTGCAATATCCAGATGGGAAAAGTTTCGTTTTAATCC<br>TCCTCCTTCTCGGCAGCAATTGGAGGCTTTGGCTAAGGTTGTGGGTGTTGATGCTGATAGGTTAGCGCGGATGTTA<br>CCTCCTGCTGGGGTGGGTATGAATCTTGAGCCGATTCGGCTTTGTGCTGCTTGTTATGTGGAGTCGCCTTGTCATC<br>GGATTGAGTGGCAGTTTAAGGTGACTCAGGGGTGTGAGGATCATCATTTAAGTTTGTTGTCTGAGTGTCCTAATTG<br>TGGGGCTAGGTTTAAAGTTCCGGCGTTGTGGGTTGATGGTTGGTGTCTTCGGTGTTTTACGCTGTTTGGGGAGATG<br>GTAAAGAGTCAGAATTTTATTGAATCACATAACAAAATTTAAACATAAATCTTCAAAATTCCTATTCGATAATAC<br>TTTCAGCCATTCTTTGATTTTATAAATGCCTAAATTTTTATTTTCAGTCACATAACCGTCACATAAGATTAATTTAT<br>TTATTCCATAGATATAAATAATCATTTATGCCCAAAATGGCACATATTTAGCGTGTTTCTTAGATTTATTTTCAGG<br>ATCATAGGGCTTAATTAAGTTTTCATTAATTGTATCCGCAATAATTCGGGAAGCCATAGAATAGTTTTACATCAAA<br>ACTTATCCCCGTAGACAGCCAATATACCAAAGCAGCCAGTTCCACCAGATTAGACCTGGAGTAATAAATACTGCG<br>TCCCGTTCCCGTCTCACTAATCACAGGCACAACAATCCCTTTCTCTCGCCATACTTGGATCTGGCGGAGAGTACAA<br>CCTGTAATTTGAGCCGCTTCCTTACTTGTGAAAAATGTTTCTTGCATAAAAAACTATTTTACAGAAAGAAGCTATA<br>GTACAAATATGGTAGTATTAAACAAATATGTTTATTATATGAGCCAAATCACTATTCAGTGCCGTCTACTGGCGA<br>GTGAATCTACCCGTCAACAGTTATGGCAATTGATGGCTGAGAAAAACACGCCACTGATTAACGAATTACTCATGC<br>AAATGGGTAAACATCCAGAATTTGAAACTTGGCGACAAAAAGGTAAACACCCCACAGGTGTAGTCAAAGAACTG<br>TGTGAACCTTTGAAAACTGATCCGCGCTTCATGGGACAACCTGCAAGGTTTTACACCAGTGCCACAGCATCAGTG<br>AACTATATTTATAAATCCTGGTTTGCCTTAATGAAGCGGTTTCAGTCCCAACTAGACGGCAAACTGCGCTGGTTAG<br>AAATGCTCAATAGTGATACTGAATTAGAAGCAGCCAGTGGAGTCTCCTTGGATGTACTTCAGACTAAATCTGCCG<br>AAATTTTGGCTCAATTTGCTGCCCAAAATCCTGCTGAAACTCAACCAGCAAAAGGTAAAAAAGGGAAAAAATCT<br>CCAACTTCAGATAGCGAACGTAATTTATCAAAAAACTTATTTGATCTTTACAGTAATACAGAAGATATTTAACT<br>CGTTGTGCCATTAGTTATTTACTCAAAAATGGCTGTAAGATTAGCAATAAAGCAGAAAATACCGATAAATTCGCT<br>CAACGTCGCCGCAAAGTAGAAATTCAAATTCAACGTTTGACAGAAAAATTAGCTGCTCGAATCCCTAAAGGACG<br>AGATTTAACTGATACCCTAAGATTGGAAACTCTTTTTAATGCTACTCAGACTGTTCCTGAAAATGAAACCGAGGC<br>GAAATTATGGCAAAATATTCTGTTAAGAAAATCTAGTCAAGTGCCGTTTCCAGTGGCTTACGAACCAACGAGAA<br>TTTAGTTTGGTTTAAAAATCAATTTGGGCGGATATGTGTAAAATTCAGTGGCTTGAGTGAGCATACTTTTCAAATT<br>TATTGTGATTCTCGCCAACTTCACTGGTTTCAAAGATTCCTAGAAGATCAACAAATTAAGAAGATAGTAAGAAT<br>CAACATTCTAGTGCTTTATTTACCCTGCGAAGTGGTCGTATTTCTTGGCAGGAAGGACAAGGCAAGGGAGAACCC<br>TGGAATATTCACCATTTAACTCTTTATTGTTCTGTAGATACTCGTTTGTGGACAGGAAGAAGGAACAAATTTAGTCA<br>AAGAAGAAAAGCCGAAGAAATTGCTAAAACCATCACCCAGACAAAAACCAAAGGTGATCTTAATGATAAACA<br>ACAGGCACATCTCAAACGTAAAAGTTCTTCTTTAGCTAGAATTAATAACCATTTCCCTCGTCCTAGCCAACCTTTA<br>TATAAGGGACTATCTCATATTCTAGTTGGTGTGAGTTTAGGTTTAGAAAACCCTGCCACAATTGCAGTTGTAGATG<br>GTACAACGGGAAAGTTTTGACATATCGCAACATTAAACAACTACTTGGTGAAAGTTATAAATTACTCAATAGAC<br>AGCGACAACAAAAACACCTGTTATCCCACGAACGCCATGTCGCTCAAAGGATGTCAGCACCAAATCAATTTGGA<br>GATTCAGAGTTAGGGGAATATATAGATAGATTACTTGCAAAAGAAATTATTGCAGTTGCCCAAACATATAAAGCT |

TABLE 30-continued

```
                GGCAGTATTGTTATTCCAAAATTGGGAGATATGCGAGAGCAAATTCAGAGTGAAATTCAATCTAAAGCTGAACA
                AAAATCAGATATAATAGAGGTTCAACAAAAGTATGCCAAGCAATATCGAACTACTGTTCATCAGTGGAGCTACG
                GTAGATTAATCTCTAATATTCAAAGTCAGGCAAGTAAAGCAGGAATCGCTATAGAGGAGGGAAAACAACCAATT
                CGAGCGAGTCCATTAGAGAAAGCCAAAGAATTAGCGATAAGGCCTATCAATCCCGAAAAGCCTGATTGACAAA
                ATACCGAACCTTAATAATAGAATAGGAATTAACAATAGCGCCGCAGTTCATGTTTTTGATAAACCTCTGTTCGGT
                GACAAATGCGGGTTAGGTTGACTGTTGTGAGACAGTTGTGCTTTCTGACCCTGGTAGCTGCCTACCTTGATGCTGC
                TGTTCCTTGTGAACAGGAATAAGGTGCGCCCCCAGTAATAGAGGTGCGGGTTTACCGCAGTGGTGGCTACCGAAT
                CACCTCCGAGCAAGGAGGAATCCACCTTAATTATTTATTTTTGGCGAACCATAAGCGAGGTCAAAAACCCTGGGG
                TTCTGCCAAAGGTCTAAATCCGTTGTCTAGTCTGTGTTTCAGATGTTAAGATGCTTTGATAATGTTCTCTTCAGAG
                GGAAATTAGGAGCAAATTTAGGACATCTGCCAAAATTGCTTTTGGAGGTGTCTTTAGATAAGGGTTTGGTCGGGC
                GGAGTTTTAACACCCCTCCCGGAGTGGGGCGGGTTGAAAGACACAGATGGAAGATCACCACGGCACAGGATTTA
                TAGGTTTCAACACCCCTCCCGGATTGGGGCGGGTTGAAAGACATTTATGCAAGTATAATAAAAAATATCTGGGTG
                GGTTGAAAGATCAGTAGGTCGTGGGTTTAACTCTGAAAACACTATATAAATACAGTGTTGCTTGTGATAGTTAGG
                GACAATTAATTTGTTAACAGTGACACGAATTAGTTAAAATGACATTAATCTGTTAACAGTGACAAATAAATTGTT
                AATGTACACGAACGTACAACCTAAAGCCGATGATGAGATTTGAACTCACGACCTACTGATTACGAATCAGTTGCT
                CTACCCCTGAGCCACATCGGCGCATACAGTCTAGTATAATAACATAATTTACTAATGATG

Trans-          MYMRNETPITPDNLETESVTAKDTQIIVSELSDEAKLKMEIIQSLLEAGDRTTYAQRLKEAAVKLGKSVRTVRRLIDKW
posase          EQEGLVGLTQTDRVDKGKHRVDENWQEFILKTYKEGNKGGKRMTRQQVAIRVKVRADQLGVKPPSHMTVYRILEPV
(SEQ ID         IEKQEKAKSIRTPGWRGSRLSLKTRDGLDLSVEYSNHIWQCDHTRADILLVDQHGELLARPWLTTVIDTYSRCIIGINLG
NO: 909)        FDAPSSQVVALALRHAILPKKYGAEYGLHEEWGTYGKPEHFFTDGGKDFRSNHLQQIGVQLGFACHLRDCPSEGGIVE
                RPFGTLNTDLFSTLPGYTGSNVQERPEEAEKEACLTLRELERLLVRYLVDKYNQSIDARLGDQTRYQRWEAGLIVAPN
                LISEEDLRICLMKQTRRSIYRGGYLQPENLTYRGENLAGYAGESVVLRFDPKDITTILVYRQTGFQEEFLARAYAQDLE
                TEELSLDEAKAMSRRIRQAGKEISNRSILAEVRDRETFVKQKKTKKERQKEEQVVVEKASSERSRTAKKPVIVEPEEIEV
                ASVESSSDTDMPEVFDYEQMREDYGW TniB            MISQQAQGVAQELGDILPNDEKLQAEIHRLNRKSFIPLEQVKMLHDWLDGKRQSRQSGRVLGESRTGKTMGCDAYRL
(SEQ ID         RHKPKQEPGKPPTVPVAYIQIPQECSAKELFAAIIEHLKYQMTKGTVAEIRDRTLRVLKGCGVEMLIIDEADRFKPKTFA
NO: 910)        EVRDIFDKLEIAVILVGTDRLDAVIKRDEQVYNRFRACHRFGKFSGEDFKRTVEIWERQVLKLPVASNLSGKAMLKTL
                GEATGGYIGLLDMILRESAIRALKKGLSKIDLETLKEVTAEYK TniQ            MEVGEINPWLFQVEPFEGESISHFLGRFRRANDLTTTGLGKAAGVGGAISRWEKFRFNPPPSRQQLEALAKVVGVDAD
(SEQ ID         RLARMLPPAGVGMNLEPIRLCAACYVESPCHRIEWQFKVTQGCEDHHLSLLSECPNCGARFKVPALWVDGWCLRCFT
NO: 911)        LFGEMVKSQNFIESHNKI Cas12k          MEVGEINPWLFQVEPFEGESISHFLGRFRRANDLTTTGLGKAAGVGGAISRWEKFRFNPPPSRQQLEALAKVVGVDAD
(SEQ ID         RLARMLPPAGVGMNLEPIRLCAACYVESPCHRIEWQFKVTQGCEDHHLSLLSECPNCGARFKVPALWVDGWCLRCFT
NO: 912)        LFGEMVKSQNFIESHNKI
```

Example 18

This example shows testing of CAST system T59 (CP003548/*Nostoc* sp. PCC 7107) discussed in Example 13. T59 NLS-B, C, NLS-Q, and NLS-K or NLS-B, C, NLS-GFP-Q, and NLS-GFP-K were co-transfected into HEK-293 cells. Two days later, the cells were harvested, and the lysate from these cells was added to an in vitro transposition assay with or without sgRNA targeting FnPSP1. The gel shows the result of PCR detection of insertion products from this assay (FIG. 74A). PCR bands from the above reaction were sequenced using NGS, demonstrating verified insertions with an RGTR PAM, approximately 60 bp downstream of the PAM region (FIG. 74B).

Example 19 Plasmid Targeting in Mammalian Cells

N-term NLS tagged TnsB, untagged TnsC, NLS-sfGFP tagged TniQ, and N-term sfGFP-tagged Cas12k from T59 (CP003548/*Nostoc* sp. PCC 7107), were co-transfected into HEK293T cells along with T59 donor plasmid, in vitro transcribed guide RNA, and a plasmid containing the target for the corresponding single guide RNA using Lipofectamine 2000. Schemicate show in FIG. 75. After 72 hours, DNA was extracted from the cells using Lucigen QuickExtract and PCR performed on insertion products. NGS sequences (FIGS. 76A-D) show verified plasmid insertions from plasmid targeting assay in mammalian cells. Insertions are found 59-64 bp downstream of the PAM sequence for 4 different protospacers with AGTA and GGTG protospacer adjacent motifs (PAMs) in two different plasmid regions.

TABLE 31

Target Sequences

VEGF-
TGGCTCTGGGCTCCCCTGCCCAAGCTAATGTCATAGTGGAGGCCTCAGGC
CCTGCACCAACATGGTTCCGTAGTCCCTGGAGTCAGGCTGGGGGAGCCCA
GGGCTGAGGCTCCCTTTCATCCCCTCCCACCAGGAAAGGGTCTTTCTCGG
TATTTCCCACAAACACTCATATCACCACTTGACAGCCTTTTCATTCCATT
CTCCCGCCTCTCTCAGCCCCACCACACCCCTGACACATTCCTTCCCCCAC
TTCAGCTCCTGGATCGCAGGCAGGGGCACCCTGCCTATCCCCTCTCCCAA
AGCGGGTGCCTGGGAGCTGACATCTTGGCTCACCTTCTCCTCCTTTGTCT
TCTCTTCCTTTCCCCCACTCCCCAGCATTTCATCCAAGCCAGAAATGGGC
CTAGAAGTCTGTAGAAAGACATCCCGCTGCTATCACTCCACAAATCCTCT
AGAGAAGATGAGTTTGGTAGACCTCTGCTTATCTGATTTAAATTCTTCTT
GCTGTAATCTCAGCTGTTCTGGTTGGTGGCAATGGGCAAACTCAGGATGT
TGGTCAGACAATGGACTGAAGAGTTTACTTTTCTCTGCTTCCCTGCCCAA
CTGTACTTGAGTAATCTTTATAGTATCTCTAAAAGATGGTCCTGGAATGG
TGCTCCCTGGTCCTTCCCTGTCTCTTGCAGTCGGCCAGGACACAGGCGGG
AGTATCCACAGCTCTCATTTTACAGCTTCCTTCCCGTTCCCTACAGCAAT
AGAGGGGGAGCCCTAACGGGGTTTTAGCAATCAGTCCAGCCCCTTCAGTC
TGGAAAGGAGGACACTGAGGCAGGGATGGGCGGTGCCTTGCTCCAGGCCA
CACAACAAGGCAGTGACAGTGGCTGCGTTTGAACCCAGGTGTCCTAACCT
CCAGGACCCACACATGGCAATCTGAGGAACTGCTCGGGGAGCAGAGTGCT
TAATGACAGGGCTTCAGGGACACTATTTGTCAGAGGGCTTTCAAGGTAA
CTCCTGTGGTGGTGTTGGGAGGGGGTGCTCAGCCGATGCCTAGTCTCTCT
GTAGCCTTGGTGGGGAGGCCACTGTGACCCAGGTCAGCTTGCCTGGAACA
GCTGGGTTTCTGGAAACACTTCTCTCTTCTCTATGGGGCCCTGTCGTGGG
TGGTGGTGGTAGACGGGGTTTGTTTGTGTGTGTATGTGTGGTTTAGTA
GTCCCTGCAGCCTTCAGCCTGGAAAGCTGAGGAGGCATGGAGAGGCAGGG
GGTTGGTGGATGAGTGACGGGAGGGAAATGCAGTGGGGAGGAGATGCCA
CCGCAGGGCTACGGTCAGAGTTGGTGAAGGGCAGATTCACCGTGCCTCCC
TCTGTCCTCCTTAAGACCTCTGGTCATGCCAGGGTCTTATGGAGGGGGCT
TGGTGCTCCGCACTGTATTTGTTGCTCTCTCTGGAGTTGCTGTACCAACT
CTCCTGGCATCCCGACAGGCAGGAGTATGTCCCATAGCCACAGAAATGCC
CTTTTTGCAGGTTCTTCCTAGTTCTTGGAGGGCTAGAAGGAACTGAGGGG
ATGTGAAGAGCATCTTTCCTCCTAGCTTGTTCCCCACTGCCCAGGCTTGC
TCCCCGACAGTGAATGGGAAGTGGGGAGCAGTCACCTTCCCAGGGGGCTC

TABLE 31-continued

Target Sequences

CAGAAAGCTGAGGACAGAGTAGCTAAGCTCACAGAGGAGCACTTAGTCAA
TGGGACTGACCCAGGAGGGCCCCGGGACAATGGGGCTAGGCAGAAAGGAG
CAAGAAAGAAGGAGGCAAGGAGGGATGGAGACATCTGAGGAAAGACAGAG
AAGGAAGGGAAAAGGAAATGCTCTGTTCACCCATAACTGTCCATGATCTG
GACACTTGGGGTTGGAATTCCACCCCAGAGCTGGGGCTTGCCTTGTCTAC
CATGTTTTCAACAGTGTCTAGGTCCCATGAGTCCACCGCCTCAGGCCTGG
CCTCTGGAATTGAAGGCCTGGTGAGGTACCTGCTATGTTGGGTGTGGGCT
ACACTTATGCATGAAGATTAGTGGGGAGTCCTGGCCTGGCCTTTCCAAGA
GAGGAGGAGGTAGGGAGGCGTGCAGACCAGGGACCCAGACAGGCCTCATT
CTCAGCAGGGAGCTGCACATTCCAGCCTAGAGTCAAGAGCGGACTGGGGC
AGGGCAGACATTCCACCCAGCACGCCTCCTGATTGATTGGT
AAATAGCTGTTGTTCCAGTCCTTGAGTTCCCCCTGTGCCTCTCTGGCCAC
CCCAGTCCCTTACTTGGTCCCCTGGACCTCTCCACCATCCAGAAATTGAG
GTTTATGTCTGGCTTGGCATACGCCGTCAGCTCTATGTGAACTGTGCCTG
AGCCATAGCAGGTGTTAAATGTTTTGGCCATCATCCTGAGCTCCGCAGGG
GCCTTGTGCCCCACAGCTGGAGCTGACTGCGACCAGGTCCTGGAACTTGG
AGAAGCTGGCAGCAGGCACAGCAGCTCTGAGCATGCCCTGCCTCACTTCT
CCTGATGCTTCCAGCTGTGTTCTGAAGGAGATGGGTCTGGATAAGCAGG
CTGGCATGCAGGGAGATGTAGGCGGGACCATCTCTGCAGGAGACCCCAGT
AGGGAATGGTTTAGCTGTGGCCTCTGCAGGGCACTGCCTGGAGTAAGGGA
GTGCTGAGCCCCTAGGGAAGGAGGGAGCAAACAACAGATCCCTGGGTCA
GCTGCTGACACACTCCTATGCACGCGGCATCTAGTTCTAGCACCTCCTCT
CTGGCACTGCCTGGCTCCCCACCCAGCCAGTCAGCTCTTAGAGGCAGAAG
CCCAGTGTATCCCAAAGGTGCCTGGCTCAGTGCTGGGCCCCGATTAAATG
ATGAAGTGGCCTGGGGAGGTAGAAAGAGCCCCAGGCTGTGAGTTGAGTGA
TCTGGGTTGAGGTCTTGACTCTATGCAGCGCTCCGGCTTTGGACAACTCT
GGGCTTCCTTCTGCTCCTCTGGCCAGTAAGCTTCTTTAGCAGTGGAAACT
TTTCCTCAAATGAAATTCCAAGTGAGGGGCCAATAAATGAAGCAGATAAA
ACTGCATGTACTGTGTTTGCCCACTCCCACACCTTCCTGCTACCTGTCCC
ATCTCTGAGGACCCTCAAGACTCCTAGGAGCACAGTCTGATGTTCTCCTG
ACATGGATATCCTCTGACTAATTGCCTGCTTCCCTGAATATCTCGAGGAT
ATTGGGCCAGGCTGATCCTGGAAGCTGAGGGGAGCCTCCCACTCCTCA
TGCCCTGTACTTCTGGGTCTGGGAAAGCAGGGAGTATGGTGGGACTTTGA
ATCCAAAGTCCCTGTACTTTCCACTGCCCTACCTAGATGTCCCTGTACCT
CCTGTAAAATCAGCATAGAGCCTGGTGCCTGGTAGTTCCTACAAATATTC
ACAAATTGGAGCTTAGCTCAGCTCTCAGGGGGCCAATCAGGGGGCCAATC
ATTAACTGGCTTTATCTTTGTGAACCATCCTGGGGGGCCCAGGTCATCGC
CCCAGCTTCCAGCCCAGGCCCAGGGGGCTGCTGGGGGAAGGGGCCCTTCT
TGCTGGGAGGTAGGGGGCGCCTTGGGTCCCTGCCTCTTTTTTTTCCTGGG
ACTTCCCCGAAGGAACTCACATTGCAGTCAACTCAGTGACAACCTAGTTA
CATAGTTGCTTCAAATAAAGACTAAAGCAGGATCCAAGCCAACAGATCCC
CCAACCCCTAGTCATCTTTGGCACGCATTATGTAATTTCTTGCTTTTCTT
TTTTTTTAACCAGGGGTGGGGTAAACCCATTTCCCTATTTGTTTCTGTTT
TACTTTAGCCAGATGATAGTGGGTTTGCATTCTCTAAGAGTTTGCTCACG
AATGGGGGTGGGAACAGGAGACAGGGAAGGGAAAAACATTTATATGATAC
CTACTCTGGGCAAGGAGCTTAGCTGATGTTTGCTGTTTCCATATATTTTC
CTACAACCCTGGGAGGTAAGAACCATGAACCTCATTTTACAGATGAGGAA
ACTGAGGCTCAGACAAGATAAGTGAATTGTCCAAGTCTCAAGCTTGGAA
GTGTTGAACCAAGATCAAACCCAGCCTGTCTGGCTTTTTCCATTACTCGC
TATGGGGGTGGTGGGGTGGAGAAAGGGGAGTGGGTGGGTGGCTGAGGCTT
TTCACAGTGAGGGGTTCATCAAGCTGGTGTCTTTCCTGAAAGGACAGAGGT
CTGGCATCTCAGGTAACAGAGGAAGCGGTTCCCTACCTGCTGGGATTTGA
GGGGTTCATAAGAACTGCTTCTCCCTTCCATCACTTGGTGCTGAGCCCCA
GATTTCACCACTAGTGCTAGATTTCTTTGAGTTAAGCACTGCCCTCTCCA
AGAGGCTTTTAAAACACACAGGCCCTGGAAGATGTGACATTTGGTATCAG
TCATCTCATCTGGAGTGTTTGAGGGAGATGTTACAGGCTCACAGAGCTC
AGAGCTTAGGGAGTGGAACCTCATGCTTTACCCAGGAGAAGCCTGAGGTC
CAGCAAGGGGAGCTGACTCGGCCAAGGTCACACAGCATGCAACAGATCT
GGAAATTTTTTTTTTTTTTAGACGGAGTCTCGCTTTGTCGCCCAGGCTG
GAGTGCAGTGGTGCCATCTTGGCTTACTTGCCTCCTGGGTTTAAGTGATT
CTCCTGCCTCAGCCTCCCAAGTAGTTGGTACTATAGGCATGCATGCAACAC
GCCTGGCTAACTTTTGTATTTTTAGTAGAGACAGGGTTTCACCATGTTGG
CCAGGCTGATCTTGAACTCCTGACCTCAGGTGATCTGCCCATCTCGGCCT
CCCAAAGTGCTGAGATTACAGACGTGAGCCACCACACCCAGCCAGACTCA
GGACTTTTTTGCCCAGTGCTGTCTGTTTCGAAGTCGCCACATGCCTGTGA
TAGACAGGAGGGCTCTGGGTACCAGGTAATGAAGTGAGGGATTAAAGCTG
GAGGAAATGTATCTTTCTGCTTTATGCCTTGGCCCAGCTGAGTGGCCCTG
TGCTCGTCACAGGCTGGTGTCCTCTGCTCTCCTCCCCTCACTCCTGGGGC
AAGCAACAGTGGTGTTCATGTGTGAGCTGGACCTACACTAGTGTTGGC
TTGTTTAAATTCTCTGACAGACAAACTGTCCCGGGGGCGGGAAGGC
AGTGTGGAGCTCACCCCCTGAGGGAGCAGCATTGTCTCTGTGGGCTTTGG
CTGGGAATGTTTCTGAAGACGCCCTAATCCCTTGCCCTGCCTAGCCTCAA
AGTCTCTATCACTCAGAGGAGTACTGGGAGGCTCAGTGTGAGCCATCAG
AACCTTCCAGGGTATCTTCCCTTGCTTGTTCTCTTTGCGCAGTCCACTTG
GTTTGCTAAACTCCTGCTCTTCCATCAAGACCCAACTCAAGGCCAGGCAC
GGTGGCTCACGCCTGTAATCCCAGCACTCTGGGAGGCAGAGGTGGGCCGA
TCACTTGAGGTCAGGAGTTCGAGACCAGCCTGGGCAACATGGTGAAACAC
CATCTCTACTAAAAACACAAAAATTAGCCAGGTGTGGTGGCAGGCACCTG

CAGTCCCAGCTACTCCGGAGGCTGAGGCAGGAGAATTGCTCGAACCTGGG
AGGCAGGGGTTGCAGTGAGCCGACATGGCGCCACTGCACTCCAGTCTGGG
CGACAGAGTGAGACCCTATCTCAAAAAAAAAAAAAAAAAAAAAGACCCA
ACTCAAGTATCATCTCCAGGAAGCCTTCCCCTACTCCCAGCAATTAAATG
CTCCTCAGAGAATTCCCATTTTTGGTTTACTCTTTGGTTTACCTCCAGAC
AGGAAGCCCCCACTGACACTGTTGTAGTCCCAGGGTGCAACACAAAGCAG
AGATCACAACGTGAGTTTAATAATTGCTTGTGGAATACATGTCCCAAGCC
ACCTCCTGCAGGAAGCCCTTCCAGATGCCCATTCTAGCCAGTCTGGCTCT
TTGCTTCCATACCTTCACAACACTTGTGCCTCCCCCAGGGCCTCTTTCTC
ATCTTGCTTTCTGGGGCAGCTGTGTGCACATTTGTCTGTGTGCAGCAACT
CTCTAAGGCAGGGATTTTTACTCCTATTTTTGATGAGGGGAGCTGTGGCT
CAGAGAGGTTGAATAACCTAAGGCCACACAGTGAGTGGCAGAGCCAGGAA
TGTGACTTGGGTCCATTTGAATCCAAAGTCCCTGTACTTTCCACTGCCCT
ACCTAGATGTCCCTGTACCTCCTATAAAATCAGCATGGGAGCCTGGTGCCT
GGTAGTCCCTACAAATATTCACAAATTGGAGCTTAGCTCAGCTCTCAGGC
AAGGCCCAGGTCAAAAGGGCAGATACAGCTTTGGGACCTTAGTTGCCACC
ACATGCCCATACCTTCTTCCCAGCAGAAGGACTCCCTCCAAGACAGGGTAG
GGGTGGAGGATGTGAACAGGGGCAGAAATGGGCATGTTTTGGGGTCAGAC
TTGAGGAATAGCAGAGATTTGGAGTGTCAGAAGGTGAGCATGCCTGGGGG
TGTTGGGGAGATGCAATTCATCAGGGACAGCTTAGTGTCAGGGGATTAGA
CTGGGGCCCATGAAGGAGAGGCAGAGGCTGATGGGCCTAGGGGTGGTGTG
GGTAGGTGAGCTTCCCCAGACAGTGACTCTGCCCTGCCCTCTCTCCAGCT
AGGTCCTCTTCCCCATTCCTTCCCCCTTTCCTGACTGGATCCTCTTGGGA
GAGTTACCCTCCTTGGCTTCCTCTGCTCCAATCTTTTTATCAGTTGGCCA
TCATTACTTATCATTACCTCAAGTCAAACCTCCAGATCCACATGGGGCTA
GGACATTGGCACTGGACCAAAGAGGCCCTTTCCTTTGCTTTCTCTTTGTC
TTTTTAATGCTTTGTTGCAAAGACCTAGGCGGGAGAGAGAGAGAGAGAG
AGAGACAGAGATTGACCCACAGTCAGGGTCAGGGAATTGAGGGGAACCAA
CCCAATTCTCTCTCCTTCAATTCACCAGGTTTGTATCCTGCCCTTCCTGC
AGATCAGTGTCCTGCTAGTCACCTGGGGGTCAGGGGATGGAGTGAAGGAC
AAGACCTCCTTCCATTGCAGTGAAGCCACTTGGAGAAATGTGTGGAAAAC
AGCAAGACCCAGTGACTCTCTCCTCACCTTCTTTCCAATCTCAGGAGAGA
TTTTGTCCCTTCATCCACCGGCTTCTAGATTAACCACCCACACCCACACA
GGCGAGAGTTTCCCTGAATATTGGAGGTGACAGGACATCAGGACAAAGTA
CAACTATTGTGCCTTGGCCCAATCACTACTTTCTTTGTCTGGGGCCGCCG
CTGGCTCCTGGCTGCCTTTCGCACTTTTCTCCACCCCACCCCTTTCTCC
CCTTCCCCCTCACCTGGAACACCTTCCCTTCCTCCTTGGCTCCTTCTGA
ACTGCCTTCAGAGCCACAGACTGTGGGAGTGGCCACTGCGCTCCCAAGG
TGAGGCCCTCCAAGCGGGGCCGAGTTTGCCCCTCAACTGGGAGCCAGCAT
GACCTCTGTGTGGCTGCTCTCTGCTTCACTGCCCCTTCCCCCAATCTGC
TAGGTGACCCTGGGCCCCTTTGGCCCTCTCTGGGCCTTCGGAGGATTCT
TTGGGGAGACAGTCTGCTCTGACGCCCCTTCCCCTGCAGCAAGCAGCCTG
GGGAGGGAGGTGAGGATAAGTGAAGTCAAGTTGTTCAGGGGGCTAAGCCC
ATGGAAGGGAAGATGCCACA (SEQ ID NO: 913)

grin 2B
AATACGGTATCAGTCATTTTAGGGAAGTCACGACTATATAGGATGGCATCAG
GAAAAAAAAAGAACAAATTTCAAATGTGGCTCTAACATTACTTCAGCTG
CTAATGGTATTTGTTTAAGTTTCTGTATTTTGGTGTATAAATAGATTGGA
GTAAATATGTGTTCCTTATAATAATTGGTTATATGAGAGGCAGTTCCACGT
AGTGTAATAGAACACATATTGAATACAAAAGTCAGAAGATCTGGGTTCA
GGTTTGTTTCACTTAATTGATTGGTTCATGGTCTTAGAACACTTAGCTTC
TCTGAGCCTTGGCGTCAACATTTATAAAAATGGTGATAATAATGTTTTTC
TTATTTTATTCCCTACTGGGTCATTGTAAGGATCAATTGAGGCAATGTTT
TAAAACTACTAGTCATGTATCAGTTGTTCTTGTAGTTTAATATTAAGAGC
CAGATACTAACAAGGTTACTAAAGAATTTTCTGGCTGTTGTCCTCATTGA
GGCAAACATAAGGTGAAGGCAGCAAGAATGCAGGGCTTGTGTACTTATAG
CCCCCCACATCCAGTTTATCCAGCCCATGTTCTGTTGCTCACCTCTGCTG
AGCACGTTTTCTGCTCACTTTGTCTGGCCTTGCTTTCCTTCAGCCCAAG
AACAGTACAAGGGTGGGCTGTAACAGGAGGGCCAGGAGATTTGTGTATgc
atactcgcatggctacctggaccactcacaacctcttttcctccttt gtc
tctgcctgtagctgccaatgactatagcaatagcaccttttattgccttg
ttcaaggatttctgaggcttttgaaagtttcattttctctcattctgcag
agcaaataccagagataagagagtaggctggtagatggagtgggttt gg
tgctcaatgaaaggagataaggtccttgaattgcagtatctagcctcttc
taagacaggttacgtgatgtagatcctattttaacatgctattctttgtg
tttgcagggagtcgacgagttgaagatgaagcccagagcggagtgctgtt
ctcccaagttctggttggtgttggccgtcctggccgtgtcaggcagcaga
gctcgttctcagaagagccccccccagcattggcattgctgtcatcctcgt
gggcacttccgacgaggtggccatcaaggatgcccacgagaaagatgatt
tccaccatctctccgtggtaccccgggtggaactggtagccatgaatgag
accgacccaaagagcatcatcacccgcatctgtgatctcatggtctgaccg
gaagattccaggggtggtgtttgctgatgacacagaccaggaagccatcg
cccagatcctcgatttcatttcagcacagactctcacccccatcctgggc
atccacgggggctcctctatgataatggcagataaggtaaaagggggctg
cagggag (SEQ ID NO: 914)

TABLE 32

| Donor Sequence |
| --- |
| CGATAGCTAGACTGGGCGGTTTTATGGACAGCAAGCGAACCGGAATTGCC
AGCTGGGGCGCCCTCTGGTAAGGTTGGGAAGCCCTGCAAAGTAAACTGGA
TGGCTTTCTTGCCGCCAAGGATCTGATGGCGCAGGGGATCAAGATCTGAT
CAAGAGACAGGATGAGGATCGTTTCGCATGATTGAACAAGATGGATTGCA
CGCAGGTTCTCCGGCCGCTTGGGTGGAGAGGCTATTCGGCTATGACTGGG
CACAACAGACAATCGGCTGCTCTGATGCCGCCGTGTTCCGGCTGTCAGCG
CAGGGGCGCCCGGTTCTTTTTGTCAAGACCGACCTGTCCGGTGCCCTGAA
TGAACTGCAGGACGAGGCAGCGCGGCTATCGTGGCTGGCCACGACGGGCG
TTCCTTGCGCAGCTGTGCTCGACGTTGTCACTGAAGCGGGAAGGGACTGG
CTGCTATTGGGCGAAGTGCCGGGGCAGGATCTCCTGTCATCCCACCTTGC
TCCTGCCGAGAAAGTATCCATCATGGCTGATGCAATGCGGCGGCTGCATA
CGCTTGATCCGGCTACCTGCCCATTCGACCACCAAGCGAAACATCGCATC
GAGCGAGCACGTACTCGGATGGAAGCCGGTCTTGTCGATCAGGATGATCT
GGACGAAGAGCATCAGGGGCTCGCGCCAGCCGAACTGTTCGCCAGGCTCA
AGGCGCGCATGCCCGACGGCGAGGATCTCGTCGTGACCCATGGCGATGCC
TGCTTGCCGAATATCATGGTGGAAAATGGCCGCTTTTCTGGATTCATCGA
CTGTGGCCGGCTGGGTGTGGCGGACCGCTATCAGGACATAGCGTTGGCTA
CCCGTGATATTGCTGAAGAGCTTGGCGGCGAATGGGCTGACCGCTTCCTC
GTGCTTTACGGTATCGCCGCTCCCGATTCGCAGCGCATCGCCTTCTATCG
CCTTCTTGACGAGTTCTTCTGAATTGAAAAAGGAAGAGTATGAGGATCCA
ACATTTCCAATCACTAGTGAATTATCTAGAAGCAAATATTTGCTATCATAT
TTTTTTAGTTTAGTTATACTTCCATGAGATATTCAACAAGTATCAACCTC
AATTAAATGCAGATAAATTTAAGTTGTTGAATAACTAATTATTTGTCGTC
TTAACAAAATAATGTCGTCAAATATAAAACTATCAAAAATGTTGCTACAT
GAGTGTTTACAACGTTTTTTATTATGTAATGGGTTAGTAGTTTATTTAAC
ACTTTACTTGTCGTTGATTTAAATAATAACAAAATAAACGTCGTCTTTTA
AAATTTTACGTTTTCTAAAATTTTCTAGTTTCATAACAAATTAGCTGTCG
CTTTTTAGCTTGAATAGTGGTATTATAATTTTATTTAGTACATTTGCACTT
AAATAATACATCCTTATACCGAAAGTTGCCGCGTCCATTGAGGGGTCAA
CTGCTTTAGGAAGTTTGGATGTTCTCGCACAATAGCGAGATTGTGATTAC
TGTTTTGAGTATGAATCAAGTTTTCCTATGCCCGGACCTAACTTGTCGGG
ACCACCCGGGGTAGTCATCGGCTTATACAAGTTTCAACAACTATCCCAG | 
| CTAGGGATGAGTTGAAAGAGCGTCAGAAAATATTTAACAGAGGGTTGAAA
GGTGCATCCGACTTGTAAGCATATTTATGAATATTATCAGGGAAGTCATC
AAATAAAGATTTAGCTATATTTCCTGTACAATAGATGTCTGCAAACACTT
TATCAAATTGGTTAGACGACATTAATTTGTTAACGTTTCGCAATTAGCAT
TATACGACACTAATTTGTTAACAGTGACATTAATTTGTTAATAGCGACAG
CAATCTGTTAACAACGACAAATAATTAGTTATTCGACATAAGTTAAAGCC
AGCAGCTGGATTTGAACCTGCGACCTTCCGATTACAAGTCGGATGCACTA
CCACTGTGCTATGCTGGCATTATTAAGCTCACCGATTTATGATTATAACA
TAAGCAAAATATTTGTCTAGAGGAAGCTGCGAAAAAAATTTGCTTGGATG
TTCGAGACTGGAAGGTTAGTACTTCAACCTACGTAGAGACGTAGCAATGC
TACCTCTCTACAATGGTTTTGTATGGTGCACTCTCAGTACAATCTGCTCT
ATGGTGCACTCTCAGTACAATCTTGTAGCACCGCCTACATACCTCGCTCT
GCTAATCCTGTTACCAGCCGGTTGTCAGCCGTTAAGTGTTCCTGTGTCAC
TCAAATTGCTTTGAGAGGCTCTAAGGGCTTCTCAGTGCGTTACATCCCT
GGCTTGTTGTCCACAACCGTTAAACCTTAAAAGCTTTAAAAGCCTTATAT
ATTCTTTTTTTCTTATAAAACTTAAAACCTTAGAGGCTATTTAAGTTGC
TGATTTATATTAATTTTATTGTTCAAACATGAGAGCTTAGTACGTGAAAC
ATGAGAGCTTAGTACGTTAGCCATGAGAGCTTAGTACGTTAGCCATGAGG
GTTTAGTTCGTTAAACATGAGAGCTTAGTACGTTAAACTTGAGAGCTTAG
TACGTGAAACATGAGAGCTTAGTACGTACTATCAACAGGTTGAACTGCCC
ATGTTCTTTCCTGCGTTATCAGAGCTTATCGGCCAGCCTCGCAGAGCAGG
ATTCCCGTTGAGCACCGCCAGGTGCGAATAAGGGACAGTGAAGAAGGAAC
ACCCGCTCGCGGGTGGGCCTACTTCACCTATCCTGCCCGGCTGACGCCGT
TGGATACACCAAGGAAAGTCTACACGAACCCTTTGGCAAAATCCTGTATA
TCGTGCGAAAAGGATGGATATACCGAAAAAATCGCTATAATGACCAAGA
TCCCCTGATTCCCTTTGTCAACAGCAATGGATAATTCGATTTAACAAATG
CATGGCGCAAGGGCTGCTAAAGGAAGCGGAACACGTAGAAAGCCAGTCCG
CAGAAACGGTGCTGACCCCGGATGAATGTCAGCTACTGGGCTATCTGGAC
AAGGGAAAACGCAAGCGCAAAGAGAAAGCAGGTAGCTTGCAGTGGGCTTA
CATGG (SEQ ID NO: 915) |

TABLE 33

| | |
| --- | --- |
| sgRNA (SEQ ID NO: 916) | AUAUUUUAUAACAGCGCCGCAGUUCAUGCUUUUUUAAGCCAAUGUAC
UGUGAAAAAUCUGGGUUAGUUUGGCGGUUGGAAGGCCGUCAUGCUUUC
UGACCCUUGUAGCUGCCCGCUUCUGAUGCUGCCAUCUUUAGAAUUCUA
UAGGUGGGAUAGGUGCUCCCAGCAAUAAGGAGUAAGGCUUUUUAGCU
AUAGCCGUUAUUCAUAACGGUGCGGAUUACCACAGUGGUGGCUACUGA
AUCACCCCCUUCGUCGGGGAACCCUCCAAAAGGUGGGUUGAAAGNNN
NNNNNNNNNNNNNNNNN |
| untagged TnsC (SEQ ID NO: 917) | AGAACATGTGAGCAAAAGGCCAGCAAAAGGCCAGGAACCGTAAAAAGG
CCGCGTTGCTGGCGTTTTTCCATAGGCTCCGCCCCCCTGACGAGCATCAC
AAAAATCGACGCTCAAGTCAGAGGTGGCGAAACCCGACAGGACTATAAA
GATACCAGGCGTTTCCCCCTGGAAGCTCCCTCGTGCGCTCTCCTGTTCCGA
CCCTGCCGCTTACCGGATACCTGTCCGCCTTTCTCCCTTCGGGAAGCGTGG
CGCTTTCTCATAGCTCACGCTGTAGGTATCTCAGTTCGGTGTAGGTCGTTC
GCTCCAAGCTGGGCTGTGTGCACGAACCCCCCGTTCAGCCCGACCGCTGC
GCCTTATCCGGTAACTATCGTCTTGAGTCCAACCCGGTAAGACACGACTT
ATCGCCACTGGCAGCAGCCACTGGTAACAGGATTAGCAGAGCGAGGTAT
GTAGGCGGTGCTACAGAGTTCTTGAAGTGGTGGCCTAACTACGGCTACAC
TAGAAGAACAGTATTTGGTATCTGCGCTCTGCTGAAGCCAGTTACCTTCG
GAAAAAGAGTTGGTAGCTCTTGATCCGGCAAACAAACCACCGCTGGTAG
CGGTGGTTTTTTTGTTTGCAAGCAGCAGATTACGCGCAGAAAAAAAGGAT
CTCAAGAAGATCCTTTGATCTTTTCTACGGGGTCTGACGCTCAGTGGAAC
GAAAACTCACGTTAAGGGATTTTGGTCATGAGATTATCAAAAAGGATCTT
CACCTAGATCCTTTTAAATTAAAAATGAAGTTTTAAATCAATCTAAAGTA
TATATGAGTAAACTTGGTCTGACAGTTACCAATGCTTAATCAGTGAGGCA
CCTATCTCAGCGATCTGTCTATTTCGTTCATCCATAGTTGCCTGACTCCCC
GTCGTGTAGATAACTACGATACGGGAGGGCTTACCATCTGGCCCCAGTGC
TGCAATGATACCGCGAGACCCACGCTCACCGGCTCCAGATTTATCAGCAA
TAAACCAGCCAGCCGGAAGGGCCGAGCGCAGAAGTGGTCCTGCAACTTT
ATCCGCCTCCATCCAGTCTATTAATTGTTGCCGGGAAGCTAGAGTAAGTA
GTTCGCCAGTTAATAGTTTGCGCAACGTTGTTGCCATTGCTACAGGCATC
GTGGTGTCACGCTCGTCGTTTGGTATGGCTTCATTCAGCTCCGGTTCCCAA
CGATCAAGGCGAGTTACATGATCCCCCATGTTGTGCAAAAAAGCGGTTAG
CTCCTTCGGTCCTCCGATCGTTGTCAGAAGTAAGTTGGCCGCAGTGTTATC
ACTCATGGTTATGGCAGCACTGCATAATTCTCTTACTGTCATGCCATCCGT
AAGATGCTTTTCTGTGACTGGTGAGTACTCAACCAAGTCATTCTGAGAAT
AGTGTATGCGGCGACCGAGTTGCTCTTGCCCGGCGTCAATACGGGATAAT
ACCGCGCCACATAGCAGAACTTTAAAAGTGCTCATCATTGGAAAACGTTC
TTCGGGGCGAAAACTCTCAAGGATCTTACCGCTGTTGAGATCCAGTTCGA
TGTAACCCACTCGTGCACCCAACTGATCTTCAGCATCTTTTACTTTCACCA
GCGTTTCTGGGTGAGCAAAAACAGGAAGGCAAAATGCCGCAAAAAAGGG |

TABLE 33-continued

```
AATAAGGGCGACACGGAAATGTTGAATACTCATACTCTTCCTTTTTCAAT
ATTATTGAAGCATTTATCAGGGTTATTGTCTCATGAGCGGATACATATTTG
AATGTATTTAGAAAAATAAACAAATAGGGGTTCCGCGCACATTTCCCCGA
AAAGTGCCACCTGACGTCGACGGATCGGGAGATCTCCCGATCCCCTATGG
TGCACTCTCAGTACAATCTGCTCTGATGCCGCATAGTTAAGCCAGTATCT
GCTCCCTGCTTGTGTGTTGGAGGTCGCTGAGTAGTGCGCGAGCAAATTT
AAGCTACAACAAGGCAAGGCTTGACCGACAATTGCATGAAGAATCTGCT
TAGGGTTAGGCGTTTTGCGCTGCTTCGCGATGTACGGGCCAGATATACGC
GTTGACATTGATTATTGACTAGTTATTAATAGTAATCAATTACGGGGTCA
TTAGTTCATAGCCCATATATGGAGTTCCGCGTTACATAACTTACGGTAAA
TGGCCCGCCTGGCTGACCGCCCAACGACCCCCGCCCATTGACGTCAATAA
TGACGTATGTTCCCATAGTAACGCCAATAGGGACTTTCCATTGACGTCAA
TGGGTGGAGTATTTACGGTAAACTGCCCACTTGGCAGTACATCAAGTGTA
TCATATGCCAAGTACGCCCCCTATTGACGTCAATGACGGTAAATGGCCCG
CCTGGCATTATGCCCAGTACATGACCTTATGGGACTTTCCTACTTGGCAGT
ACATCTACGTATTAGTCATCGCTATTACCATGGTGATGCGGTTTTGGCAGT
ACATCAATGGGCGTGGATAGCGGTTTGACTCACGGGGATTTCCAAGTCTC
CACCCCATTGACGTCAATGGGAGTTTGTTTTGGCACCAAAATCAACGGGA
CTTTCCAAAATGTCGTAACAACTCCGCCCCATTGACGCAAATGGGCGGTA
GGCGTGTACGGTGGGAGGTCTATATAAGCAGAGCTCTCTGGCTAACTAGA
GAACCCACTGCTTACTGGCTTATCGAAATTAATACGACTCACTATAGGGA
GACCCAAGCTGGCTAGCGTTTAAACTTAAGCTTGCCACCATGAAGGACGA
CTACTGGCAGAGATGGGTGCAGAACCTGTGGGGCGACGAGCCCATTCCT
GAAGAACTGCAGCCCGAGATCGAGAGACTGCTGAGCCCTTCTGTGGTGG
AACTGGAACACATCCAGAAGATCCACGACTGGCTGGACGGCCTGAGACT
GTCTAAGCAGTGCGGCAGAATTGTGGCCCCTCCTAGAGCCGGCAAGAGC
GTGACATGTGACGTGTACCGGCTGCTGAACAAGCCCCAGAAGAGAGGCG
GCAAGCGGGATATTGTGCCCGTGCTGTATATGCAGGTCCCCGGCGATTGC
TCTAGCGGAGAACTGCTGGTGCTGATCCTGGAAAGCCTGAAGTACGATGC
CACCAGCGGCAAGCTGACCGACCTGAGAAGAAGAGTGCAGCGCCTGCTG
AAAGAAAGCAAGGTGGAAATGCTGATTATCGACGAGGCCAACTTCCTCA
AGCTGAACACCTTCAGCGAGATCGCCCGGATCTACGACCTGCTGAGAATC
AGCATCGTGCTCGTGGGCACCGACGGCCTGGACAACCTGATTAAGAGAG
AGCCCTACATCCACGACCGGTTCATCGAGTGCTACAAGCTGCCCCTGGTG
GAAAGCGAGAAGAAATTCACCGAGCTGGTCAAGATCTGGGAAGAAGAG
GTGCTCTGCCTGCCTCTGCCTAGCAACCTGACCAGAAGCGAGACACTGGA
ACCCCTGCGGAGAAAGACCGGCGGAAAGATCGGACTGGTGGACAGAGTG
CTGCGGAGAGCCTCTATTCTGGCCCTGAGAAAGGGCCTGAAGAATATCG
ACAAAGAAACCCTGACCGAGGTGCTGGATTGGTTCGAGTGAAATTCTGC
AGATATCCAGCACAGTGGCGGCCGCTCGAGTCTAGAGGGCCCGTTTAAA
CCCGCTGATCAGCCTCGACTGTGCCTTCTAGTTGCCAGCCATCTGTTGTTT
GCCCCTCCCCCGTGCCTTCCTTGACCCTGGAAGGTGCCACTCCCACTGTCC
TTTCCTAATAAAATGAGGAAATTGCATCGCATTGTCTGAGTAGGTGTCAT
TCTATTCTGGGGGGTGGGGTGGGGCAGGACAGCAAGGGGGAGGATTGGG
AAGACAATAGCAGGCATGCTGGGGATGCGGTGGGCTCTATGGCTTCTGA
GGCGGAAAGAACCAGCTGGGGCTCTAGGGGGTATCCCCACGCGCCCTGT
AGCGGCGCATTAAGCGCGGCGGGTGTGGTGGTTACGCGCAGCGTGACCG
CTACACTTGCCAGCGCCCTAGCGCCCGCTCCTTTCGCTTTCTTCCCTTCCT
TTCTCGCCACGTTCGCCGGCTTTCCCCGTCAAGCTCTAAATCGGGGGCTCC
CTTTAGGGTTCCGATTTAGTGCTTTACGGCACCTCGACCCCAAAAAACTT
GATTAGGGTGATGGTTCACGTAGTGGGCCATCGCCCTGATAGACGGTTTT
TCGCCCTTTGACGTTGGAGTCCACGTTCTTTAATAGTGGACTCTTGTTCCA
AACTGGAACAACACTCAACCCTATCTCGGTCTATTCTTTTGATTTATAAGG
GATTTTGCCGATTTCGGCCTATTGGTTAAAAAATGAGCTGATTTAACAAA
AATTTAACGCGAATTAATTCTGTGGAATGTGTGTCAGTTAGGGTGTGGAA
AGTCCCCAGGCTCCCCAGCAGGCAGAAGTATGCAAAGCATGCATCTCAA
TTAGTCAGCAACCAGGTGTGGAAAGTCCCCAGGCTCCCCAGCAGGCAGA
AGTATGCAAAGCATGCATCTCAATTAGTCAGCAACCATAGTCCCGCCCCT
AACTCCGCCCATCCCGCCCCTAACTCCGCCCAGTTCCGCCCATTCTCCGCC
CCATGGCTGACTAATTTTTTTTATTTATGCAGAGGCCGAGGCCGCCTCTGC
CTCTGAGCTATTCCAGAAGTAGTGAGGAGGCTTTTTTGGAGGCCTAGGCT
TTTGCAAAAAGCTCCCGGGAGCTTGTATATCCATTTTCGGATCTGATCAA
GAGACAGGATGAGGATCGTTTCGCATGATTGAACAAGATGGATTGCACG
CAGGTTCTCCGGCCGCTTGGGTGGAGAGGCTATTCGGCTATGACTGGGCA
CAACAGACAATCGGCTGCTCTGATGCCGCCGTGTTCCGGCTGTCAGCGCA
GGGGCGCCCGGTTCTTTTTGTCAAGACCGACCTGTCCGGTGCCCTGAATG
AACTGCAGGACGAGGCAGCGCGGCTATCGTGGCTGGCCACGACGGGCGT
TCCTTGCGCAGCTGTGCTCGACGTTGTCACTGAAGCGGGAAGGGACTGGC
TGCTATTGGGCGAAGTGCCGGGGCAGGATCTCCTGTCATCTCACCTTGCT
CCTGCCGAGAAAGTATCCATCATGGCTGATGCAATGCGGCGGCTGCATAC
GCTTGATCCGGCTACCTGCCCATTCGACCACCAAGCGAAACATCGCATCG
AGCGAGCACGTACTCGGATGAAGCCGGTCTTGTCGATCAGGATGATCTG
GACGAAGAGCATCAGGGGCTCGCGCCAGCCGAACTGTTCGCCAGGCTCA
AGGCGCGCATGCCCGACGGCGAGGATCTCGTCGTGACCCATGGCGATGC
CTGCTTGCCGAATATCATGGTGGAAAATGGCCGCTTTTCTGGATTCATCG
ACTGTGGCCGGCTGGGTGTGGCGGACCGCTATCAGGACATAGCGTTGGCT
ACCCGTGATATTGCTGAAGAGCTTGGCGGCGAATGGGCTGACCGCTTCCT
CGTGCTTTACGGTATCGCCGCTCCCGATTCGCAGCGCATCGCCTTCTATCG
CCTTCTTGACGAGTTCTTCTGAGCGGGACTCTGGGGTTCGAAATGACCGA
CCAAGCGACGCCCAACCTGCCATCACGAGATTTCGATTCCACCGCCGCCT
```

| | |
|---|---|
| | TCTATGAAAGGTTGGGCTTCGGAATCGTTTTCCGGGACGCCGGCTGGATG<br>ATCCTCCAGCGCGGGGATCTCATGCTGGAGTTCTTCGCCCACCCCAACTT<br>GTTTATTGCAGCTTATAATGGTTACAAATAAAGCAATAGCATCACAAATT<br>TCACAAATAAAGCATTTTTTTCACTGCATTCTAGTTGTGGTTTGTCCAAAC<br>TCATCAATGTATCTTATCATGTCTGTATACCGTCGACCTCTAGCTAGAGCT<br>TGGCGTAATCATGGTCATAGCTGTTTCCTGTGTGAAATTGTTATCCGCTCA<br>CAATTCCACACAACATACGAGCCGGAAGCATAAAGTGTAAAGCCTGGGG<br>TGCCTAATGAGTGAGCTAACTCACATTAATTGCGTTGCGCTCACTGCCCG<br>CTTTCCAGTCGGGAAACCTGTCGTGCCAGCTGCATTAATGAATCGGCCAA<br>CGCGCGGGGAGAGGCGGTTTGCGTATTGGGCGCTCTTCCGCTTCCTCGCT<br>CACTGACTCGCTGCGCTCGGTCGTTCGGCTGCGGCGAGCGGTATCAGCTC<br>ACTCAAAGGCGGTAATACGGTTATCCACAGAATCAGGGGATAACGCAGG<br>AA |
| N-term NLS-sfGFP tagged TniQ (SEQ ID NO: 918) | AGAACATGTGAGCAAAAGGCCAGCAAAAGGCCAGGAACCGTAAAAAGG<br>CCGCGTTGCTGGCGTTTTTCCATAGGCTCCGCCCCCCTGACGAGCATCAC<br>AAAAATCGACGCTCAAGTCAGAGGTGGCGAAACCCGACAGGACTATAAA<br>GATACCAGGCGTTTCCCCCTGGAAGCTCCCTCGTGCGCTCTCCTGTTCCGA<br>CCCTGCCGCTTACCGGATACCTGTCCGCCTTTCTCCCTTCGGGAAGCGTGG<br>CGCTTTCTCATAGCTCACGCTGTAGGTATCTCAGTTCGGTGTAGGTCGTTC<br>GCTCCAAGCTGGGCTGTGTGCACGAACCCCCCGTTCAGCCCGACCGCTGC<br>GCCTTATCCGGTAACTATCGTCTTGAGTCCAACCCGGTAAGACACGACTT<br>ATCGCCACTGGCAGCAGCCACTGGTAACAGGATTAGCAGAGCGAGGTAT<br>GTAGGCGGTGCTACAGAGTTCTTGAAGTGGTGGCCTAACTACGGCTACAC<br>TAGAAGAACAGTATTTGGTATCTGCGCTCTGCTGAAGCCAGTTACCTTCG<br>GAAAAAGAGTTGGTAGCTCTTGATCCGGCAAACAAACCACCGCTGGTAG<br>CGGTGGTTTTTTTGTTTGCAAGCAGCAGATTACGCGCAGAAAAAAAGGAT<br>CTCAAGAAGATCCTTTGATCTTTTCTACGGGGTCTGACGCTCAGTGGAAC<br>GAAAACTCACGTTAAGGGATTTTGGTCATGAGATTATCAAAAAGGATCTT<br>CACCTAGATCCTTTTAAATTAAAAATGAAGTTTTAAATCAATCTAAAGTA<br>TATATGAGTAAACTTGGTCTGACAGTTACCAATGCTTAATCAGTGAGGCA<br>CCTATCTCAGCGATCTGTCTATTTCGTTCATCCATAGTTGCCTGACTCCCC<br>GTCGTGTAGATAACTACGATACGGGAGGGCTTACCATCTGGCCCCAGTGC<br>TGCAATGATACCGCGAGACCCACGCTCACCGGCTCCAGATTTATCAGCAA<br>TAAACCAGCCAGCCGGAAGGGCCGAGCGCAGAAGTGGTCCTGCAACTTT<br>ATCCGCCTCCATCCAGTCTATTAATTGTTGCCGGGAAGCTAGAGTAAGTA<br>GTTCGCCAGTTAATAGTTTGCGCAACGTTGTTGCCATTGCTACAGGCATC<br>GTGGTGTCACGCTCGTCGTTTGGTATGGCTTCATTCAGCTCCGGTTCCCAA<br>CGATCAAGGCGAGTTACATGATCCCCCATGTTGTGCAAAAAAGCGGTTAG<br>CTCCTTCGGTCCTCCGATCGTTGTCAGAAGTAAGTTGGCCGCAGTGTTATC<br>ACTCATGGTTATGGCAGCACTGCATAATTCTCTTACTGTCATGCCATCCGT<br>AAGATGCTTTTCTGTGACTGGTGAGTACTCAACCAAGTCATTCTGAGAAT<br>AGTGTATGCGGCGACCGAGTTGCTCTTGCCCGGCGTCAATACGGGATAAT<br>ACCGCGCCACATAGCAGAACTTTAAAAGTGCTCATCATTGGAAAACGTTC<br>TTCGGGGCGAAAACTCTCAAGGATCTTACCGCTGTTGAGATCCAGTTCGA<br>TGTAACCCACTCGTGCACCCAACTGATCTTCAGCATCTTTTACTTTCACCA<br>GCGTTTCTGGGTGAGCAAAAACAGGAAGGCAAAATGCCGCAAAAAAGGG<br>AATAAGGGCGACACGGAAATGTTGAATACTCATACTCTTCCTTTTTCAAT<br>ATTATTGAAGCATTTATCAGGGTTATTGTCTCATGAGCGGATACATATTTG<br>AATGTATTTAGAAAAATAAACAAATAGGGGTTCCGCGCACATTTCCCCGA<br>AAAGTGCCACCTGACGTCGACGGATCGGGAGATCTCCCGATCCCCTATGG<br>TGCACTCTCAGTACAATCTGCTCTGATGCCGCATAGTTAAGCCAGTATCT<br>GCTCCCTGCTTGTGTGTTGGAGGTCGCTGAGTAGTGCGCGAGCAAAATTT<br>AAGCTACAACAAGGCAAGGCTTGACCGACAATTGCATGAAGAATCTGCT<br>TAGGGTTAGGCGTTTTGCGCTGCTTCGCGATGTACGGGCCAGATATACGC<br>GTTGACATTGATTATTGACTAGTTATTAATAGTAATCAATTACGGGGTCA<br>TTAGTTCATAGCCCATATATGGAGTTCCGCGTTACATAACTTACGGTAAA<br>TGGCCCGCCTGGCTGACCGCCCAACGACCCCCGCCCATTGACGTCAATAA<br>TGACGTATGTTCCCATAGTAACGCCAATAGGGACTTTCCATTGACGTCAA<br>TGGGTGGAGTATTTACGGTAAACTGCCCACTTGGCAGTACATCAAGTGTA<br>TCATATGCCAAGTACGCCCCCTATTGACGTCAATGACGGTAAATGGCCCG<br>CCTGGCATTATGCCCAGTACATGACCTTATGGGACTTTCCTACTTGGCAGT<br>ACATCTACGTATTAGTCATCGCTATTACCATGGTGATGCGGTTTTGGCAGT<br>ACATCAATGGGCGTGGATAGCGGTTTGACTCACGGGGATTTCCAAGTCTC<br>CACCCCATTGACGTCAATGGGAGTTTGTTTTGGCACCAAAATCAACGGGA<br>CTTTCCAAAATGTCGTAACAACTCCGCCCCATTGACGCAAATGGGCGGTA<br>GGCGTGTACGGTGGGAGGTCTATATAAGCAGAGCTCTCTGGCTAACTAGA<br>GAACCCACTGCTTACTGGCTTATCGAAATTAATACGACTCACTATAGGGA<br>GACCCAAGCTGGCTAGCGTTTAAACTTAAGCTTGCCACCATGTATCCGTA<br>TGATGTTCCGGATTATGCAGGTGGCGGAAGCGGCCCAAAGAAGAAGCGG<br>AAGGTCGGTGGCGGAAGCGGCGTGAGTAAAGGTGAAGAACTCTTCACTG<br>GAGTTGTCCCCATTCTGGTAGAGCTTGATGGAGATGTAAATGGACATAA<br>ATTCTCCGTCAGGGGCGAAGGCGAAGGGGACGCCACGAATGGTAAGCTG<br>ACTCTGAAATTCATCTGTACGACGGGCAAACTGCCCGTCCCATGGCCTAC<br>ACTCGTAACGACCCTCACCTACGGCGTGCAATGCTTTTCTCGATATCCCG<br>ACCACATGAAACAGCATGACTTTTTCAAGTCTGCAATGCCTGAAGGTTAT<br>GTTCAAGAAAGGACCATCAGCTTTAAGGATGATGGTACATATAAAACCC<br>GAGCCGAGGTTAAATTTGAAGGGGACACTCTGGTTAATCGAATTGAACTG<br>AAAGGTATTGATTTTAAGGAGGACGGTAACATACTGGGGCACAAGTTGG<br>AGTACAACTTTAACAGCCATAATGTGTATATTACCGCTGATAAGCAGAAA |

TABLE 33-continued

|  | |
|---|---|
| | AATGGGATAAAGGCCAACTTTAAGATCCGACATAATGTCGAAGATGGTA
GTGTTCAACTGGCTGATCATTACCAACAAAATACGCCCATCGGAGATGGA
CCTGTACTCTTGCCTGACAATCATTATCTCTCCACGCAATCAAAGCTTTCC
AAGGACCCAAACGAAAAGAGAGATCACATGGTCCTTCTGGAATTTGTGA
CTGCCGCAGGCATCACTCTCGGTATGGATGAGCTGTACAAGGGAGGAGG
TGGAAGCGGAGGAGGAGGAAGCGGAGGAGGAGGTAGCGAAATCGGAGC
CGAGGAACCCCACATCTTCGAGGTGGAACCTCTGGAAGGCGAGAGCCTG
TCTCACTTCCTGGGCAGATTCAGAAGAGAGAACTACCTGACCAGCAGCCA
GCTGGGCAAGCTGACAGGACTGGGAGCTGTGGTGTCCCGGTGGAAGAAG
CTGTACTTCAACCCATTTCCAACGCGGCAAGAGCTGGAAGCCCTGACCTC
TGTCGTCAGAGTGAACGCCGATAGACTGGCCGAGATGCTGCCTCCTAAGG
GCGTGACCATGAAGCCCAGACCTATCAGACTGTGCGCCGCCTGTTATGCC
GAGGTGCCCTGTCACAGAATCGAGTGGCAGTTCAAGGACGTGATGAAGT
GCGACCGGCACAACCTGAGACTGCTGACCAAGTGCACCAACTGCGAGAC
AAGCTTCCCCATTCCTGCCGAATGGGTGCAGGGCGAGTGCCCTCACTGCT
TTCTGCCTTTTGCCACCATGGCCAAGCGGCAGAAACACGGCTAAGAATTC
GATATCAAGCTTATCGGTAATCAAATTCTGCAGATATCCAGCACAGTGGC
GGCCGCTCGAGTCTAGAGGGCCCGTTTAAACCCGCTGATCAGCCTCGACT
GTGCCTTCTAGTTGCCAGCCATCTGTTGTTTGCCCCTCCCCCGTGCCTTCC
TTGACCCTGGAAGGTGCCACTCCCACTGTCCTTTCCTAATAAAATGAGGA
AATTGCATCGCATTGTCTGAGTAGGTGTCATTCTATTCTGGGGGGTGGGG
TGGGGCAGGACAGCAAGGGGGAGGATTGGGAAGACAATAGCAGGCATG
CTGGGGATGCGGTGGGCTCTATGGCTTCTGAGGCGGAAAGAACCAGCTG
GGGCTCTAGGGGGTATCCCCACGCGCCCTGTAGCGGCGCATTAAGCGCG
GCGGGTGTGGTGGTTACGCGCAGCGTGACCGCTACACTTGCCAGCGCCCT
AGCGCCCGCTCCTTTCGCTTTCTTCCCTTCCTTTCTCGCCACGTTCGCCGG
CTTTCCCCGTCAAGCTCTAAATCGGGGCTCCCTTTAGGGTTCCGATTTAG
TGCTTTACGGCACCTCGACCCCAAAAAACTTGATTAGGGTGATGGTTCAC
GTAGTGGGCCATCGCCCTGATAGACGGTTTTTCGCCCTTTGACGTTGGAG
TCCACGTTCTTTAATAGTGGACTCTTGTTCCAAACTGGAACAACACTCAA
CCCTATCTCGGTCTATTCTTTTGATTTATAAGGGATTTTGCCGATTTCGGC
CTATTGGTTAAAAAATGAGCTGATTTAACAAAAATTTAACGCGAATTAAT
TCTGTGGAATGTGTGTCAGTTAGGGTGTGGAAAGTCCCCAGGCTCCCCAG
CAGGCAGAAGTATGCAAAGCATGCATCTCAATTAGTCAGCAACCAGGTG
TGGAAAGTCCCCAGGCTCCCAGCAGGCAGAAGTATGCAAAGCATGCAT
CTCAATTAGTCAGCAACCATAGTCCCGCCCCTAACTCCGCCCATCCCGCC
CCTAACTCCGCCCAGTTCCGCCCATTCTCCGCCCCATGGCTGACTAATTTT
TTTTATTTATGCAGAGGCCGAGGCCGCCTCTGCCTCTGAGCTATTCCAGA
AGTAGTGAGGAGGCTTTTTTGGAGGCCTAGGCTTTTGCAAAAAGCTCCCG
GGAGCTTGTATATCCATTTTCGGATCTGATCAAGAGACAGGATGAGGATC
GTTTCGCATGATTGAACAAGATGGATTGCACGCAGGTTCTCCGGCCGCTT
GGGTGGAGAGGCTATTCGGCTATGACTGGGCACAACAGACAATCGGCTG
CTCTGATGCCGCCGTGTTCCGGCTGTCAGCGCAGGGGCGCCCGGTTCTTT
TTGTCAAGACCGACCTGTCCGGTGCCCTGAATGAACTGCAGGACGAGGC
AGCGCGGCTATCGTGGCTGGCCACGACGGGCGTTCCTTGCGCAGCTGTGC
TCGACGTTGTCACTGAAGCGGGAAGGGACTGGCTGCTATTGGGCGAAGT
GCCGGGGCAGGATCTCCTGTCATCTCACCTTGCTCCTGCCGAGAAAGTAT
CCATCATGGCTGATGCAATGCGGCGGCTGCATACGCTTGATCCGGCTACC
TGCCCATTCGACCACCAAGCGAAACATCGCATCGAGCGAGCACGTACTC
GGATGGAAGCCGGTCTTGTCGATCAGGATGATCTGGACGAAGAGCATCA
GGGGCTCGCGCCAGCCGAACTGTTCGCCAGGCTCAAGGCGCGCATGCCC
GACGGCGAGGATCTCGTCGTGACCCATGGCGATGCCTGCTTGCCGAATAT
CATGGTGGAAAATGGCCGCTTTTCTGGATTCATCGACTGTGGCCGGCTGG
GTGTGGCGGACCGCTATCAGGACATAGCGTTGGCTACCCGTGATATTGCT
GAAGAGCTTGGCGGCGAATGGGCTGACCGCTTCCTCGTGCTTTACGGTAT
CGCCGCTCCCGATTCGCAGCGCATCGCCTTCTATCGCCTTCTTGACGAGTT
CTTCTGAGCGGGACTCTGGGGTTCGAAATGACCGACCAAGCGACGCCCA
ACCTGCCATCACGAGATTTCGATTCCACCGCCGCCTTCTATGAAAGGTTG
GGCTTCGGAATCGTTTTCCGGGACGCCGGCTGGATGATCCTCCAGCGCGG
GGATCTCATGCTGGAGTTCTTCGCCCACCCCAACTTGTTTATTGCAGCTTA
TAATGGTTACAAATAAAGCAATAGCATCACAAATTTCACAAATAAAGCA
TTTTTTTCACTGCATTCTAGTTGTGGTTTGTCCAAACTCATCAATGTATCTT
ATCATGTCTGTATACCGTCGACCTCTAGCTAGAGCTTGGCGTAATCATGG
TCATAGCTGTTTCCTGTGTGAAATTGTTATCCGCTCACAATTCCACACAAC
ATACGAGCCGGAAGCATAAAGTGTAAAGCCTGGGGTGCCTAATGAGTGA
GCTAACTCACATTAATTGCGTTGCGCTCACTGCCCGCTTTCCAGTCGGGA
AACCTGTCGTGCCAGCTGCATTAATGAATCGGCCAACGCGCGGGGAGAG
GCGGTTTGCGTATTGGGCGCTCTTCCGCTTCCTCGCTCACTGACTCGCTGC
GCTCGGTCGTTCGGCTGCGGCGAGCGGTATCAGCTCACTCAAAGGCGGTA
ATACGGTTATCCACAGAATCAGGGGATAACGCAGGAA |
| N-termNLS-sfGFP tagged Cas12k (T59)
(SEQ ID NO: 919) | AGAACATGTGAGCAAAAGGCCAGCAAAAGGCCAGGAACCGTAAAAAGG
CCGCGTTGCTGGCGTTTTTCCATAGGCTCCGCCCCCCTGACGAGCATCAC
AAAAATCGACGCTCAAGTCAGAGGTGGCGAAACCCGACAGGACTATAAA
GATACCAGGCGTTTCCCCCTGGAAGCTCCCTCGTGCGCTCTCCTGTTCCGA
CCCTGCCGCTTACCGGATACCTGTCCGCCTTTCTCCCTTCGGGAAGCGTGG
CGCTTTCTCATAGCTCACGCTGTAGGTATCTCAGTTCGGTGTAGGTCGTTC
GCTCCAAGCTGGGCTGTGTGCACGAACCCCCCGTTCAGCCCGACCGCTGC
GCCTTATCCGGTAACTATCGTCTTGAGTCCAACCCGGTAAGACACGACTT
ATCGCCACTGGCAGCAGCCACTGGTAACAGGATTAGCAGAGCGAGGTAT |

TABLE 33-continued

```
GTAGGCGGTGCTACAGAGTTCTTGAAGTGGTGGCCTAACTACGGCTACAC
TAGAAGAACAGTATTTGGTATCTGCGCTCTGCTGAAGCCAGTTACCTTCG
GAAAAAGAGTTGGTAGCTCTTGATCCGGCAAACAAACCACCGCTGGTAG
CGGTGGTTTTTTGTTTGCAAGCAGCAGATTACGCGCAGAAAAAAAGGAT
CTCAAGAAGATCCTTTGATCTTTTCTACGGGGTCTGACGCTCAGTGGAAC
GAAAACTCACGTTAAGGGATTTTGGTCATGAGATTATCAAAAAGGATCTT
CACCTAGATCCTTTTAAATTAAAAATGAAGTTTTAAATCAATCTAAAGTA
TATATGAGTAAACTTGGTCTGACAGTTACCAATGCTTAATCAGTGAGGCA
CCTATCTCAGCGATCTGTCTATTTCGTTCATCCATAGTTGCCTGACTCCCC
GTCGTGTAGATAACTACGATACGGGAGGGCTTACCATCTGGCCCCAGTGC
TGCAATGATACCGCGAGACCCACGCTCACCGGCTCCAGATTTATCAGCAA
TAAACCAGCCAGCCGGAAGGGCCGAGCGCAGAAGTGGTCCTGCAACTTT
ATCCGCCTCCATCCAGTCTATTAATTGTTGCCGGGAAGCTAGAGTAAGTA
GTTCGCCAGTTAATAGTTTGCGCAACGTTGTTGCCATTGCTACAGGCATC
GTGGTGTCACGCTCGTCGTTTGGTATGGCTTCATTCAGCTCCGGTTCCCA
CGATCAAGGCGAGTTACATGATCCCCCATGTTGTGCAAAAAAGCGGTTAG
CTCCTTCGGTCCTCCGATCGTTGTCAGAAGTAAGTTGGCCGCAGTGTTATC
ACTCATGGTTATGGCAGCACTGCATAATTCTCTTACTGTCATGCCATCCGT
AAGATGCTTTTCTGTGACTGGTGAGTACTCAACCAAGTCATTCTGAGAAT
AGTGTATGCGGCGACCGAGTTGCTCTTGCCCGGCGTCAATACGGGATAAT
ACCGCGCCACATAGCAGAACTTTAAAAGTGCTCATCATTGGAAAACGTTC
TTCGGGGCGAAAACTCTCAAGGATCTTACCGCTGTTGAGATCCAGTTCGA
TGTAACCCACTCGTGCACCCAACTGATCTTCAGCATCTTTTACTTTCACCA
GCGTTTCTGGGTGAGCAAAAACAGGAAGGCAAATGCCGCAAAAAAGGG
AATAAGGGCGACACGGAAATGTTGAATACTCATACTCTTCCTTTTTCAAT
ATTATTGAAGCATTTATCAGGGTTATTGTCTCATGAGCGGATACATATTTG
AATGTATTTAGAAAAATAAACAAATAGGGGTTCCGCGCACATTTCCCCGA
AAAGTGCCACCTGACGTCGACGGATCGGGAGATCTCCCGATCCCCTATGG
TGCACTCTCAGTACAATCTGCTCTGATGCCGCATAGTTAAGCCAGTATCT
GCTCCCTGCTTGTGTGTTGGAGGTCGCTGAGTAGTGCGCGAGCAAAATTT
AAGCTACAACAAGGCAAGGCTTGACCGACAATTGCATGAAGAATCTGCT
TAGGGTTAGGCGTTTTGCGCTGCTTCGCGATGTACGGGCCAGATATACGC
GTTGACATTGATTATTGACTAGTTATTAATAGTAATCAATTACGGGGTCA
TTAGTTCATAGCCCATATATGGAGTTCCGCGTTACATAACTTACGGTAAA
TGGCCCGCCTGGCTGACCGCCCAACGACCCCCGCCCATTGACGTCAATAA
TGACGTATGTTCCCATAGTAACGCCAATAGGGACTTTCCATTGACGTCAA
TGGGTGGAGTATTTACGGTAAACTGCCCACTTGGCAGTACATCAAGTGTA
TCATATGCCAAGTACGCCCCCTATTGACGTCAATGACGGTAAATGGCCCG
CCTGGCATTATGCCCAGTACATGACCTTATGGGACTTTCCTACTTGGCAGT
ACATCTACGTATTAGTCATCGCTATTACCATGGTGATGCGGTTTTGGCAGT
ACATCAATGGGCGTGGATAGCGGTTTGACTCACGGGGATTTCCAAGTCTC
CACCCCATTGACGTCAATGGGAGTTTGTTTTGGCACCAAAATCAACGGGA
CTTTCCAAAATGTCGTAACAACTCCGCCCCATTGACGCAAATGGGCGGTA
GGCGTGTACGGTGGGAGGTCTATATAAGCAGAGCTCTCTGGCTAACTAGA
GAACCCACTGCTTACTGGCTTATCGAAATTAATACGACTCACTATAGGGA
GACCCAAGCTGGCTAGCGTTTAAACTTAAGCTTGCCACCATGTATCCGTA
TGATGTTCCGGATTATGCAGGTGGCGGAAGCGGCCCAAAGAAGAAGCGG
AAGGTCGGTGGCGGAAGCGGCGTGAGTAAAGGTGAAGAACTCTTCACTG
GAGTAGTGCCCATTCTGGTAGAGCTTGATGGAGATGTAAATGGACATAA
ATTCTCCGTCAGGGGCGAAGGCGAAGGGGACGCCACGAATGGTAAGCTG
ACTCTGAAATTCATCTGTACGACGGGCAAACTGCCCGTCCCATGGCCTAC
ACTCGTAACGACCCTCACCTACGGCGTGCAATGCTTTTCTCGATATCCCG
ACCACATGAAACAGCATGACTTTTTCAAGTCTGCAATGCCTGAAGGTTAT
GTTCAAGAAAGGACCATCAGCTTTAAGGATGATGGTACATATAAAACCC
GAGCCGAGGTTAAATTTGAAGGGGACACTCTGGTTAATCGAATTGAACTG
AAAGGTATTGATTTTAAGGAGGACGGTAACATACTGGGGCACAAGTTGG
AGTACAACTTTAACAGCCATAATGTGTATATTACCGCTGATAAGCAGAAA
AATGGGATAAAGGCCAACTTTAAGATCCGACATAATGTCGAAGATGGTA
GTGTTCAACTGGCTGATCATTACCAACAAAATACGCCCATCGGAGATGGA
CCTGTACTCTTGCCTGACAATCATTATCTCCCACGCAATCAAAGCTTTCC
AAGGACCCAAACGAAAAGAGAGATCACATGGTCCTTCTGGAATTTGTGA
CTGCCGCAGGCATCACTCTCGGTATGGATGAGCTGTACAAGGGAGGAGG
TGGAAGCGGAGGAGGAGGAAGCGGAGGAGGAGGTAGCAGCGTGATCAC
CATCCAGTGCAGACTGGTGGCCGAAGAGGACATCCTGAGACAGCTGTGG
GAGCTGATGGCCGACAAGAACACCCCTCTGATCAACGAGCTGCTGGCCC
AAGTGGGAAAGCACCCCGAGTTTGAGACATGGCTGGACAAGGGCAGAAT
CCCCACCAAGCTGCTGAAAACCTGGTCAACAGCTTCAAGACCCAAGAG
AGATTCGCCGACCAGCCTGGCAGATTCTACACCTCTGCCATTGCTCTGGT
GGACTACGTGTACAAGAGTTGGTTCGCCCTGCAGAAGCGGCGGAAGAGA
CAGATCGAGGGCAAAGAGAGATGGCTGACCATCCTGAAGTCCGACCTGC
AGCTGGAACAAGAGTCCCAGTGTAGCCTGAGCGCCATCAGGACCAAGGC
CAACGAGATCCTGACACAGTTCACCCCTCAGAGCGAGCAGAACAAGAAC
CAGCGGAAGGGCAAAAGACCAAGAAGTCCACCAAGTCCGAGAAGTCC
AGCCTGTTCCAGATCCTGCTGAACACCTACGAGCAGACCCAGAATCCTCT
GACCAGATGCGCCATTGCCTACCTGCTGAAGAACAACTGCCAGATCAGC
GAGCTGGACGAGGACAGCGAGGAATTCACCAAGAACCGCCGGAAGAAA
GAGATTGAGATCGAGCGCCTGAAGAATCAGCTGCAGAGCAGGATCCCTA
AGGGCAGAGATCTGACCGGCGAGGAATGGCTCAAGACCCTGGAAATCAG
CACCGCCAACGTGCCCCAGAACGAGAATGAAGCCAAGGCCTGGCAAGCC
GCTCTGCTGAGAAAAAGCGCCGACGTGCCATTTCCTGTGGCCTACGAGAG
```

TABLE 33-continued

|  | |
|---|---|
| | CAACGAGGACATGACCTGGCTGCAGAACGACAAAGGCAGACTGTTCGTG<br>CGGTTCAACGGCCTGGGCAAGCTGACCTTCGAGATCTACTGCGACAAGCG<br>GCATCTGCACTACTTCAAGCGGTTTCTCGAGGACCAAGAGCTGAAGCGGA<br>ACCACAAGAATCAGTACAGCAGCTCCCTGTTCACCCTGCGGAGTGGTAGA<br>CTTGCTTGGAGCCCTGGCGAGGAAAAAGGCGAGCCCTGGAAAGTGAACC<br>AGCTGCACCTGTACTGCACCCTGGACACCAGAATGTGGACCATCGAGGG<br>AACCCAGCAGGTCGTGGACGAGAAAAGCACCAAGATCAACGAAACCCTG<br>ACAAAGGCCAAGCAGAAGGACGACCTGAACGACCAGCAGCAGGCCTTCA<br>TCACCAGACAGCAGAGCACACTGGACCGGATCAACAATCTGTTCCCCAG<br>ACCTAGCAAGAGCAGATACCAGGGCCAGCCTTCTATCCTCGTGGGCGTGT<br>CCTTCGGCCTGAAAAAGCCTGTGACAGTGGCCGTGGTGGACGTGGTCAA<br>GAATGAGGTGCTGGCCTACAGAAGCGTGAAACAGCTGCTGGGCGAGAAC<br>TACAATCTGCTGAACCGGCAGCGACAGCAGCAGAGACTGTCTCACG<br>AGAGACACAAGGCCCAGAAGCAGAACGCCCCTAACAGCTTTGGCGAGTC<br>TGAGCTGGGCCAGTACATCGACAGACTGCTGGCTGACGCCATCATTGCCA<br>TTGCCAAGACATACCAGGCCGGCTCCATCGTGCTGCCCAAGCTGAGAGAT<br>ATGAGAGAGCAGATCAGCAGCGAGATCCAGAGCAGAGCCGAGAAGAAG<br>TGCCCCGGCTACAAAGAGGTGCAGCAGAAGTACGCCAAAGAATACCGGA<br>TGAGCGTGCACCGGTGGTCCTACGGCAGACTGATCGAGTGCATCAAGAG<br>CCAGGCCGCCAAGGCCGGAATCTCTACAGAGATCGGCACCCAGCCTATC<br>CGGGGCTCTCCTCAAGAGAAGGCCAGAGATGTGGCCGTGTTCGCCTACCA<br>AGAAAGACAGGCCGCTCTGATCTGAGAATTCGATATCAAGCTTATCGGTA<br>ATCAAATTCTGCAGATATCCAGCACAGTGGCGGCCGCTCGAGTCTAGAGG<br>GCCCGTTTAAACCCGCTGATCAGCCTCGACTGTGCCTTCTAGTTGCCAGC<br>CATCTGTTGTTTGCCCCTCCCCCGTGCCTTCCTTGACCCTGGAAGGTGCCA<br>CTCCCACTGTCCTTTCCTAATAAAATGAGGAAATTGCATCGCATTGTCTG<br>AGTAGGTGTCATTCTATTCTGGGGGGTGGGGTGGGGCAGGACAGCAAGG<br>GGGAGGATTGGGAAGACAATAGCAGGCATGCTGGGGATGCGGTGGGCTC<br>TATGGCTTCTGAGGCGGAAAGAACCAGCTGGGGCTCTAGGGGGTATCCC<br>CACGCGCCCTGTAGCGGCGCATTAAGCGCGGCGGGTGTGGTGGTTACGC<br>GCAGCGTGACCGCTACACTTGCCAGCGCCCTAGCGCCCGCTCCTTTCGCT<br>TTCTTCCCTTCCTTTCTCGCCACGTTCGCCGGCTTTCCCCGTCAAGCTCTA<br>AATCGGGGGCTCCCTTTAGGGTTCCGATTTAGTGCTTTACGGCACCTCGA<br>CCCCAAAAAACTTGATTAGGGTGATGGTTCACGTAGTGGGCCATCGCCCT<br>GATAGACGGTTTTTCGCCCTTTGACGTTGGAGTCCACGTTCTTTAATAGTG<br>GACTCTTGTTCCAAACTGGAACAACACTCAACCCTATCTCGGTCTATTCTT<br>TTGATTTATAAGGGATTTTGCCGATTTCGGCCTATTGGTTAAAAAATGAG<br>CTGATTTAACAAAAATTTAACGCGAATTAATTCTGTGGAATGTGTGTCAG<br>TTAGGGTGTGGAAAGTCCCCAGGCTCCCCAGCAGGCAGAAGTATGCAAA<br>GCATGCATCTCAATTAGTCAGCAACCAGGTGTGGAAAGTCCCCAGGCTCC<br>CCAGCAGGCAGAAGTATGCAAAGCATGCATCTCAATTAGTCAGCAACCA<br>TAGTCCCGCCCCTAACTCCGCCCATCCCGCCCCTAACTCCGCCCAGTTCCG<br>CCCATTCTCCGCCCCATGGCTGACTAATTTTTTTTATTTATGCAGAGGCCG<br>AGGCCGCCTCTGCCTCTGAGCTATTCCAGAAGTAGTGAGGAGGCTTTTTT<br>GGAGGCCTAGGCTTTTGCAAAAAGCTCCCGGGAGCTTGTATATCCATTTT<br>CGGATCTGATCAAGAGACAGGATGAGGATCGTTTCGCATGATTGAACAA<br>GATGGATTGCACGCAGGTTCTCCGGCCGCTTGGGTGGAGAGGCTATTCGG<br>CTATGACTGGGCACAACAGACAATCGGCTGCTCTGATGCCGCCGTGTTCC<br>GGCTGTCAGCGCAGGGGCGCCCGGTTCTTTTTGTCAAGACCGACCTGTCC<br>GGTGCCCTGAATGAACTGCAGGACGAGGCAGCGCGGCTATCGTGGCTGG<br>CCACGACGGGCGTTCCTTGCGCAGCTGTGCTCGACGTTGTCACTGAAGCG<br>GGAAGGGACTGGCTGCTATTGGGCGAAGTGCCGGGGCAGGATCTCCTGT<br>CATCTCACCTTGCTCCTGCCGAGAAAGTATCCATCATGGCTGATGCAATG<br>CGGCGGCTGCATACGCTTGATCCGGCTACCTGCCCATTCGACCACCAAGC<br>GAAACATCGCATCGAGCGAGCACGTACTCGGATGGAAGCCGGTCTTGTC<br>GATCAGGATGATCTGGACGAAGAGCATCAGGGGCTCGCGCCAGCCGAAC<br>TGTTCGCCAGGCTCAAGGCGCGCATGCCCGACGGCGAGGATCTCGTCGTG<br>ACCCATGGCGATGCCTGCTTGCCGAATATCATGGTGGAAAATGGCCGCTT<br>TTCTGGATTCATCGACTGTGGCCGGCTGGGTGTGGCGGACCGCTATCAGG<br>ACATAGCGTTGGCTACCCGTGATATTGCTGAAGAGCTTGGCGGCGAATGG<br>GCTGACCGCTTCCTCGTGCTTTACGGTATCGCCGCTCCCGATTCGCAGCGC<br>ATCGCCTTCTATCGCCTTCTTGACGAGTTCTTCTGAGCGGGACTCTGGGGT<br>TCGAAATGACCGACCAAGCGACGCCCAACCTGCCATCACGAGATTTCGAT<br>TCCACCGCCGCCTTCTATGAAAGGTTGGGCTTCGGAATCGTTTTCCGGGA<br>CGCCGGCTGGATGATCCTCCAGCGCGGGGATCTCATGCTGGAGTTCTTCG<br>CCCACCCCAACTTGTTTATTGCAGCTTATAATGGTTACAAATAAAGCAAT<br>AGCATCACAAATTTCACAAATAAAGCATTTTTTCACTGCATTCTAGTTGT<br>GGTTTGTCCAAACTCATCAATGTATCTTATCATGTCTGTATACCGTCGACC<br>TCTAGCTAGAGCTTGGCGTAATCATGGTCATAGCTGTTTCCTGTGTGAAA<br>TTGTTATCCGCTCACAATTCCACACAACATACGAGCCGGAAGCATAAAGT<br>GTAAAGCCTGGGGTGCCTAATGAGTGAGCTAACTCACATTAATTGCGTTG<br>CGCTCACTGCCCGCTTTCCAGTCGGGAAACCTGTCGTGCCAGCTGCATTA<br>ATGAATCGGCCAACGCGCGGGGAGAGGCGGTTTGCGTATTGGGCGCTCTT<br>CCGCTTCCTCGCTCACTGACTCGCTGCGCTCGGTCGTTCGGCTGCGGCGA<br>GCGGTATCAGCTCACTCAAAGGCGGTAATACGGTTATCCACAGAATCAG<br>GGGATAACGCAGGAA |
| N-term NLS tagged TnsB (SEQ ID NO: 920) | AGAACATGTGAGCAAAAGGCCAGCAAAAGGCCAGGAACCGTAAAAAGG<br>CCGCGTTGCTGGCGTTTTTCCATAGGCTCCGCCCCCCTGACGAGCATCAC<br>AAAAATCGACGCTCAAGTCAGAGGTGGCGAAACCCGACAGGACTATAAA |

TABLE 33-continued

```
GATACCAGGCGTTTCCCCCTGGAAGCTCCCTCGTGCGCTCTCCTGTTCCGA
CCCTGCCGCTTACCGGATACCTGTCCGCCTTTCTCCCTTCGGGAAGCGTGG
CGCTTTCTCATAGCTCACGCTGTAGGTATCTCAGTTCGGTGTAGGTCGTTC
GCTCCAAGCTGGGCTGTGTGCACGAACCCCCCGTTCAGCCCGACCGCTGC
GCCTTATCCGGTAACTATCGTCTTGAGTCCAACCCGGTAAGACACGACTT
ATCGCCACTGGCAGCAGCCACTGGTAACAGGATTAGCAGAGCGAGGTAT
GTAGGCGGTGCTACAGAGTTCTTGAAGTGGTGGCCTAACTACGGCTACAC
TAGAAGAACAGTATTTGGTATCTGCGCTCTGCTGAAGCCAGTTACCTTCG
GAAAAAGAGTTGGTAGCTCTTGATCCGGCAAACAAACCACCGCTGGTAG
CGGTGGTTTTTTTGTTTGCAAGCAGCAGATTACGCGCAGAAAAAAGGAT
CTCAAGAAGATCCTTTGATCTTTTCTACGGGGTCTGACGCTCAGTGGAAC
GAAAACTCACGTTAAGGGATTTTGGTCATGAGATTATCAAAAAGGATCTT
CACCTAGATCCTTTTAAATTAAAAATGAAGTTTTAAATCAATCTAAAGTA
TATATGAGTAAACTTGGTCTGACAGTTACCAATGCTTAATCAGTGAGGCA
CCTATCTCAGCGATCTGTCTATTTCGTTCATCCATAGTTGCCTGACTCCCC
GTCGTGTAGATAACTACGATACGGGAGGGCTTACCATCTGGCCCCAGTGC
TGCAATGATACCGCGAGACCCACGCTCACCGGCTCCAGATTTATCAGCAA
TAAACCAGCCAGCCGGAAGGGCCGAGCGCAGAAGTGGTCCTGCAACTTT
ATCCGCCTCCATCCAGTCTATTAATTGTTGCCGGGAAGCTAGAGTAAGTA
GTTCGCCAGTTAATAGTTTGCGCAACGTTGTTGCCATTGCTACAGGCATC
GTGGTGTCACGCTCGTCGTTTGGTATGGCTTCATTCAGCTCCGGTTCCCAA
CGATCAAGGCGAGTTACATGATCCCCCATGTTGTGCAAAAAAGCGGTTAG
CTCCTTCGGTCCTCCGATCGTTGTCAGAAGTAAGTTGGCCGCAGTGTTATC
ACTCATGGTTATGGCAGCACTGCATAATTCTCTTACTGTCATGCCATCCGT
AAGATGCTTTTCTGTGACTGGTGAGTACTCAACCAAGTCATTCTGAGAAT
AGTGTATGCGGCGACCGAGTTGCTCTTGCCCGGCGTCAATACGGGATAAT
ACCGCGCCACATAGCAGAACTTTAAAAGTGCTCATCATTGGAAAACGTTC
TTCGGGGCGAAAACTCTCAAGGATCTTACCGCTGTTGAGATCCAGTTCGA
TGTAACCCACTCGTGCACCCAACTGATCTTCAGCATCTTTTACTTTCACCA
GCGTTTCTGGGTGAGCAAAAACAGGAAGGCAAAATGCCGCAAAAAAGGG
AATAAGGGCGACACGGAAATGTTGAATACTCATACTCTTCCTTTTTCAAT
ATTATTGAAGCATTTATCAGGGTTATTGTCTCATGAGCGGATACATATTTG
AATGTATTTAGAAAAATAAACAAATAGGGGTTCCGCGCACATTTCCCCGA
AAAGTGCCACCTGACGTCGACGGATCGGGAGATCTCCCGATCCCCTATGG
TGCACTCTCAGTACAATCTGCTCTGATGCCGCATAGTTAAGCCAGTATCT
GCTCCCTGCTTGTGTGTTGGAGGTCGCTGAGTAGTGCGCGAGCAAAATTT
AAGCTACAACAAGGCAAGGCTTGACCGACAATTGCATGAAGAATCTGCT
TAGGGTTAGGCGTTTTGCGCTGCTTCGCGATGTACGGGCCAGATATACGC
GTTGACATTGATTATTGACTAGTTATTAATAGTAATCAATTACGGGGTCA
TTAGTTCATAGCCCATATATGGAGTTCCGCGTTACATAACTTACGGTAAA
TGGCCCGCCTGGCTGACCGCCCAACGACCCCCGCCCATTGACGTCAATAA
TGACGTATGTTCCCATAGTAACGCCAATAGGGACTTTCCATTGACGTCAA
TGGGTGGAGTATTTACGGTAAACTGCCCACTTGGCAGTACATCAAGTGTA
TCATATGCCAAGTACGCCCCCTATTGACGTCAATGACGGTAAATGGCCCG
CCTGGCATTATGCCCAGTACATGACCTTATGGGACTTTCCTACTTGGCAGT
ACATCTACGTATTAGTCATCGCTATTACCATGGTGATGCGGTTTTGGCAGT
ACATCAATGGGCGTGGATAGCGGTTTGACTCACGGGGATTTCCAAGTCTC
CACCCCATTGACGTCAATGGGAGTTTGTTTTGGCACCAAAATCAACGGGA
CTTTCCAAAATGTCGTAACAACTCCGCCCCATTGACGCAAATGGGCGGTA
GGCGTGTACGGTGGGAGGTCTATATAAGCAGAGCTCTCTGGCTAACTAGA
GAACCCACTGCTTACTGGCTTATCGAAATTAATACGACTCACTATAGGGA
GACCCAAGCTGGCTAGCGTTTAAACTTAAGCTTGCCACCATGTATCCGTA
TGATGTTCCGGATTATGCAGGTGGCGGAAGCGGCCCAAAGAAGAAGCGG
AAGGTCGGTGGCGGAAGCGGCGACGAGATGCCCATCGTGAAGCAGGACG
ACGAGAGCCTGCCTGTGGAAAAACAACGACGATGTGGATGAGATCCAGGA
CGATGAGCTGGAAGAGACAAACGTGATCTTCACCGAGCTGAGCGCCGAG
GCCAAGCTGAAGATGGATGTGATTCAGGGCCTGCTGGAACCCTGCGACA
GAAAGACATACGGCGAGAAGCTGAGAGTGGCCGCCGAGAAACTGGGAA
AGACAGTGCGGACAGTGCAGCGGCTGGTCAAGAAGTATCAGCAGGACGG
CCTGAGCGCCATCGTGGAAACCCAGAGAAACGACAAGGGCAGCTACCGG
ATCGACCCCGAGTGGCAGAAATTCATCGTGAACACCTTCAAAGAGGGCA
ACAAGGGCTCCAAGAAGATGACCCCTGCTCAGGTGGCCATGAGAGTGCA
AGTTCGGGCTGAACAGCTGGGCCTGCAGAAATTTCCCAGCCACATGACCG
TGTACCGGGTGCTGAACCCCATCATCGAGCGGCAAGAGCGGAAGCAGAA
GCAGAGAAACATCGGCTGGCGGGCAGCAGAGTGTCCCACAAGACAAGA
GATGGCCAGACACTGGACGTGCGGTACAGCAATCACGTGTGGCAGTGCG
ACCACACCAAGCTGGATGTCATGCTGGTGGACCAGTACGGCGAGCCTCTT
GCCAGACCATGGTTCACCAAGATCACCGACAGCTACAGCCGGTGCATCAT
GGGCATCCACGTGGGCTTTGATGCCCCTAGCTCTCAGGTTGTGGCCCTGG
CCTCTAGACACGCCATTCTGCCTAAGCAGTACAGCGCCGAGTACAAACTG
ATCAGCGACTGGGGCACCTACGGCGTGCCCGAGAATCTGTTTACAGACG
GCGGCAGAGACTTCAGAAGCGAGCACCTGAAGCAGATCGGCTTCCAGCT
GGGCTTCGAGTGTCACCTGAGAGACAGACCTAGCGAAGGCGGCATCGAG
GAAAGAAGCTTCGGAACAATCAATACCGAGTTCCTGAGCGGCTTCTACG
GCTACCTGGGCAGCAACATCCAAGAGAGAAGCAAGACCGCCGAGGAAG
AGGCCTGTCTGACACTGAGAGAGCTGCATCTGCTGCTCGTGCGCTACATC
GTGGACAACTACAACCAGAGGCTGGACGCCCGGACCAAGGACCAGACCA
GATTTCAGAGATGGGAGGCCGGACTGCCTGCTCTGCCCAAGATGGTCAA
AGAGCGCGAGCTGGACATCTGCCTGATGAAGAAACCCGGCGGAGCATC
TACAAAGGCGGCTATCTGAGCTTCGAGAACATCATGTACCGGGGCGATTA
```

TABLE 33-continued

```
CCTGGCCGCCTATGCCGGCGAGAATATCGTGCTGAGATACGACCCCAGA
GACATCACCACCGTGTGGGTGTACAGAATCGATAAGGGCAAAGAGGTGT
TCCTGTCCGCCGCTCATGCCCTGGATTGGGAGACAGAACAGCTGTCCCTG
GAAGAAGCCAAGGCCGCCTCTAGAAAAGTGCGGAGCGTGGGCAAGACCC
TGAGCAACAAGTCTATCCTGGCCGAGATCCACGACCGGGACACCTTTATC
AAGCAGAAGAAGAAGTCCCAGAAAGAGCGCAAGAAAGAGGAACAGGCC
CAGGTCCACGCCGTGTACGAGCCTATCAATCTGAGCGAGACAGAGCCCCT
GGAAAACCTGCAAGAGACACCCAAGCCTGTGACCAGAAAGCCCCGGATC
TTCAACTACGAGCAGCTGCGGCAGGACTACGACGAGTAAGAATTCGATA
TCAAGCTTATCGGTAATCAAATTCTGCAGATATCCAGCACAGTGGCGGCC
GCTCGAGTCTAGAGGGCCCGTTTAAACCCGCTGATCAGCCTCGACTGTGC
CTTCTAGTTGCCAGCCATCTGTTGTTTGCCCCTCCCCCGTGCCTTCCTTGA
CCCTGGAAGGTGCCACTCCCACTGTCCTTTCCTAATAAAATGAGGAAATT
GCATCGCATTGTCTGAGTAGGTGTCATTCTATTCTGGGGGGTGGGGTGGG
GCAGGACAGCAAGGGGGAGGATTGGGAAGACAATAGCAGGCATGCTGG
GGATGCGGTGGGCTCTATGGCTTCTGAGGCGGAAAGAACCAGCTGGGGC
TCTAGGGGGTATCCCCACGCGCCCTGTAGCGGCGCATTAAGCGCGGCGG
GTGTGGTGGTTACGCGCAGCGTGACCGCTACACTTGCCAGCGCCCTAGCG
CCCGCTCCTTTCGCTTTCTTCCCTTCCTTTCTCGCCACGTTCGCCGGCTTTC
CCCGTCAAGCTCTAAATCGGGGCTCCCTTTAGGGTTCCGATTTAGTGCTT
TACGGCACCTCGACCCCAAAAAACTTGATTAGGGTGATGGTTCACGTAGT
GGGCCATCGCCCTGATAGACGGTTTTTCGCCCTTTGACGTTGGAGTCCAC
GTTCTTTAATAGTGGACTCTTGTTCCAAACTGGAACAACACTCAACCCTA
TCTCGGTCTATTCTTTTGATTTATAAGGGATTTTGCCGATTTCGGCCTATT
GGTTAAAAAATGAGCTGATTTAACAAAAATTTAACGCGAATTAATTCTGT
GGAATGTGTGTCAGTTAGGGTGTGGAAAGTCCCCAGGCTCCCCAGCAGG
CAGAAGTATGCAAAGCATGCATCTCAATTAGTCAGCAACCAGGTGTGGA
AAGTCCCCAGGCTCCCCAGCAGGCAGAAGTATGCAAAGCATGCATCTCA
ATTAGTCAGCAACCATAGTCCCGCCCCTAACTCCGCCCATCCCGCCCCTA
ACTCCGCCCAGTTCCGCCCATTCTCCGCCCCATGGCTGACTAATTTTTTTT
ATTTATGCAGAGGCCGAGGCCGCCTCTGCCTCTGAGCTATTCCAGAAGTA
GTGAGGAGGCTTTTTTGGAGGCCTAGGCTTTTGCAAAAAGCTCCCGGGAG
CTTGTATATCCATTTTCGGATCTGATCAAGAGACAGGATGAGGATCGTTT
CGCATGATTGAACAAGATGGATTGCACGCAGGTTCTCCGGCCGCTTGGGT
GGAGAGGCTATTCGGCTATGACTGGGCACAACAGACAATCGGCTGCTCT
GATGCCGCCGTGTTCCGGCTGTCAGCGCAGGGGCGCCCGGTTCTTTTTGT
CAAGACCGACCTGTCCGGTGCCCTGAATGAACTGCAGGACGAGGCAGCG
CGGCTATCGTGGCTGGCCACGACGGGCGTTCCTTGCGCAGCTGTGCTCGA
CGTTGTCACTGAAGCGGGAAGGGACTGGCTGCTATTGGGCGAAGTGCCG
GGGCAGGATCTCCTGTCATCTCACCTTGCTCCTGCCGAGAAAGTATCCAT
CATGGCTGATGCAATGCGGCGGCTGCATACGCTTGATCCGGCTACCTGCC
CATTCGACCACCAAGCGAAACATCGCATCGAGCGAGCACGTACTCGGAT
GGAAGCCGGTCTTGTCGATCAGGATGATCTGGACGAAGAGCATCAGGGG
CTCGCGCCAGCCGAACTGTTCGCCAGGCTCAAGGCGCGCATGCCCGACG
GCGAGGATCTCGTCGTGACCCATGGCGATGCCTGCTTGCCGAATATCATG
GTGGAAAATGGCCGCTTTTCTGGATTCATCGACTGTGGCCGGCTGGGTGT
GGCGGACCGCTATCAGGACATAGCGTTGGCTACCCGTGATATTGCTGAAG
AGCTTGGCGGCGAATGGGCTGACCGCTTCCTCGTGCTTTACGGTATCGCC
GCTCCCGATTCGCAGCGCATCGCCTTCTATCGCCTTCTTGACGAGTTCTTC
TGAGCGGGACTCTGGGGTTCGAAATGACCGACCAAGCGACGCCCAACCT
GCCATCACGAGATTTCGATTCCACCGCCGCCTTCTATGAAAGGTTGGGCT
TCGGAATCGTTTTCCGGGACGCCGGCTGGATGATCCTCCAGCGCGGGGAT
CTCATGCTGGAGTTCTTCGCCCACCCCAACTTGTTTATTGCAGCTTATAAT
GGTTACAAATAAAGCAATAGCATCACAAATTTCACAAATAAAGCATTTTT
TTCACTGCATTCTAGTTGTGGTTTGTCCAAACTCATCAATGTATCTTATCA
TGTCTGTATACCGTCGACCTCTAGCTAGAGCTTGGCGTAATCATGGTCAT
AGCTGTTTCCTGTGTGAAATTGTTATCCGCTCACAATTCCACACAACATAC
GAGCCGGAAGCATAAAGTGTAAAGCCTGGGGTGCCTAATGAGTGAGCTA
ACTCACATTAATTGCGTTGCGCTCACTGCCCGCTTTCCAGTCGGGAAACC
TGTCGTGCCAGCTGCATTAATGAATCGGCCAACGCGCGGGGAGAGGCGG
TTTGCGTATTGGGCGCTCTTCCGCTTCCTCGCTCACTGACTCGCTGCGCTC
GGTCGTTCGGCTGCGGCGAGCGGTATCAGCTCACTCAAAGGCGGTAATAC
GGTTATCCACAGAATCAGGGGATAACGCAGGAA
```

Example 16

Twinstrep-SUMO tagged Q was purified with or without TnsB/TnsC/Cas12K present in *E. coli*. A ~70 kD protein band was present when TniQ was co-expressed with TnsB/TnsC/Cas12k that was not present when Q was purified alone. Purified Cas12K was run on the same gel to help reveal the possible identity of the new band. The result is shown in FIG. 77.

Constructs that contain the T59 proteins co-expressed from a single vector under the CMV promoter, where C-term GFP tagged Cas12k was linked using T2A to either NLS-XTEN-TnsC (v5/v7) or NLS-GS-TnsC (v6/v8) followed by a internal ribosome entry site (IRES). The IRES was followed by either N-term GFP tagged TniQ (v5/v6) or NLS-TniQ (v7/v8) linked using a T2A to NLS-TnsB. The constructs were named as T59-T2A-V5 to T59-T2A-V8. The sequences and maps are shown below.

TABLE 34

Figure 78:
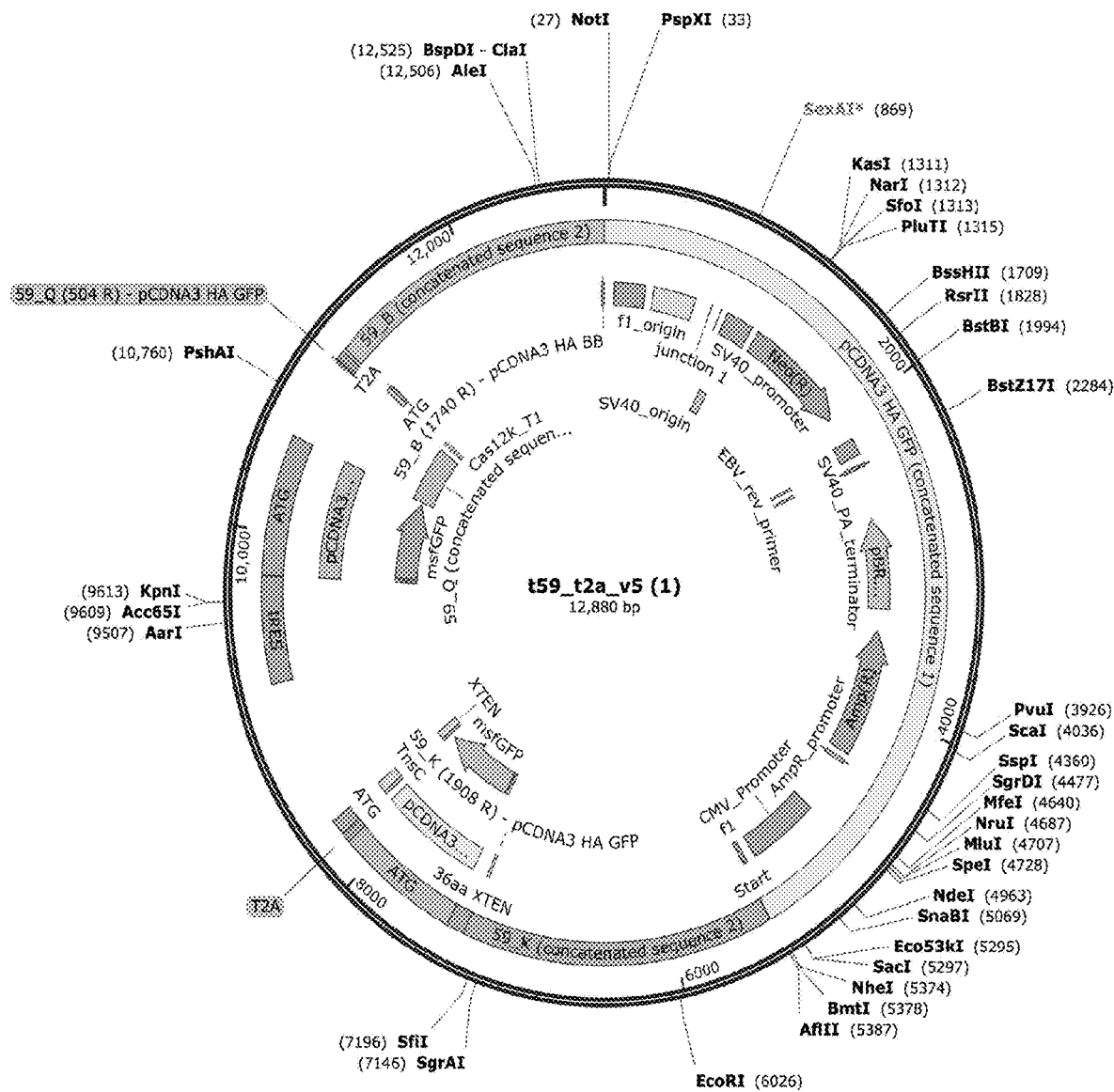

| Constructs | Maps | Sequences |
|---|---|---|
| T59-T2A-V5 (SEQ ID NO: 921) | FIG. 78 | aattctgcagatatccagcacagtggcgcgctcgagtctagagggcctcgagtcgatcagccgttaaacccgctgatcagcctgactgtgccttctagttgccagcatctgtgt
ttgccctccccgtgcttccttgacccgcagacagcaggaggattgggaagacattggagacaatagcacggcatgtggggatgcgtgggctctatgcttctgaggcgaa
agaaccagctgggctcaggggtatccccacgcctcaggggtaccccacgcccgtgagcggccgcattaagccgcgcgcggccgtcgcggccgtcgcagctccaagctcaagacgagacgccacacttgc
cagccctagcgccctgacccgctcgcttcttccttctccacgtcgcttcgcaatctgattaggggtgatgtcacgtaggcgcatggcgccgtgatcgcgtcgcctttaggtcgagtcca
agtgcttacggcaccgaccctcttgtcaaactgatcaaaaactggaaacaacatctcaaactggagctctgcatgggcatgcgcctgatgcttcttttgattatacggattccggcgcctatggttaaaaa
cgttcttaatagtggactcttgtcaaactggaacaacatctcaaactctcggctctatctttgattgattatagggattcgcctattggcctattggtaaaaa
tgagtcgatttaacaaaaattaacgcaattaattcttgtgaatgttgtcagtcagttgtgagtgtggaaatgcagcagaagtatgcaaagc
atgcatctcaattagtcagcaaccaggtgtggaaagtcccaagctccccagaggcagaagtatgcaaagctgcaagactcaattagtcagcaaccatagtcc
gccccctaactcgcccccatccgcaaggtcgaagtcgaagtctcccgcgccaactcgccaatcagccgccaatcgccctatatccgaggctgactaatttttttattacagagccgagcccctctg
cctctgatactatccagaagtagtgaaggagtcttttggaggcctaggtctgcagccaggtcacctgctctccggagcctctgaagacgactcgggatctgatcaagaga
ggatgagaagtcctcagcatgaagcaacaagaatgaatgaacaaagttgcacgcaggtcacgtattcgcgtgaccctgaccactggcaacagacaat
cgctgcctgatcgcgccgcgtgctccgccacgacgggctcgcagcgagggcctcctgcgcagtgcgtcctgcgcagccacgcgtgacgctcaatgaacgcagagacaagcagagacgag
gagcgggctacgtcgtggctggctggccacgacgggtccttgcgcacgcgttccttgcgactggtgtcactgaagtggaaggatggctattggcgaagtg
ccggggcaggatccctgcatccactcgtccgccgagaaatatccatcatgccgtgccgagctgcctgcgtgtgcacctgtggatcgcgcttgatcctggtactcgccca
ttcgaccaccagacaacacatcgcagccggaacatcgagacgagacgtactcaggtgaagccggtcttgtcgtgaccagtagcgccgctcgaagaaggctcgc
gcagccgacaactgtcgcaggcagctgcaggctcaaggctcaaggctcaaggcccatcagcgcatgcacgcgcccgagccgggccaagctgatctcgagtgcgaatacaggtcgcgaa
tgccgcttttctcgattcatcgactctcgttccggttcgtactacgtcgcgcatacgcagatctctctctgacgcctctgacgagtcttctcggcatcagtctgcatcagttctcggagcc
aatgggtgaccgctcctcgcttccaggtgaagcctcgcggccatcaccaccccaactcttcgatcctgcgagcagtcttctcttcatgaagcttgggcttcggactgtttccggagcc
tcgaaatgaccgaccagaccgacccccaacctgcatcgcgaagcttgctaaaaaggctcttccagcgctgtcctgaccaacgtctaagttgggcttcggatcaatagcatcacaa
ggctggatctccccagcgcggggatctcatgcggattctcactgattctagtgttgtcgcccaccaccaactgttattgagcttatcatgctgtatatatccgtcgaccctcagtgaagagctagaggtgagctgtaagaagg
tttcacaaatagacatttttcactgcattctagttgtgtttgtcaaactcatcaacatacgagccggaagcaaagtggaaaggtacctggggtgctaatgagtggag
catgtcatagtgctgttcctcgtgaattgtatgcgctcacgcgcttccagtcggatactccggagctcgatccggaaagctgggcccttcctcatagctccagctgtaggtatccacgt
ctaactcacattaattggttgctcactgccgcttccagtcggaaactgtgcccgcgcagctgcactaatgaatccgcaactatcgctgtgatcacccggta
tggtaggttgtcctccaagctgatgcgcccacccggcgagccgcgccttacgccgccttaacctatcgcttgagtcaaccggta
gcgtattgggcgcttcctcctccacgtctatgtgcaccccactgatgagcggcgctcagagtgtgctcagatgtcttgaagtggtgctcaactacg
cacagaatcaggggataacgcaggaaacactgacgcatcacaaaatcgacgctcaccgtgaccgtcgcgccttaaaaggcagagttgcgcagttcatcagg
ctccgcccccgacgagcatcacaaatgcacgctaccgcggcctcatagctcacgcgtggggaagcgtggcgttctcatagctcacgctgtaggtatccatcagt
tcggtaggctgctcgctgccaagctgggtcgtgtgcacaccccttcatcgcgcctgaaactatcgtcttgagtcaaccgta
agacacgactatccgcactgcagcgaccaccggtaacaggattagagaggtatgcaggagggcgtactccgcgccaaacaccaaccaccggtga
gtcacaggaacagttagggctcctgctctcgctctgcttccaagtcagtacctgaagaaaagtttgatccttcctcacgggtctgacgctcagtggaacgaaa
tctaaggatgtttgtcatgcagatatcaaaaagatctcaagaagatcctttaaaatataaaatgaaagttcaactaaaatataatattatgtatatatgagtatgtcc
gttgacagttaccagttcttgagatcatttcgccgcttgcctgtcactctgcgcaatattcgcaagcactggccgaagaagttcatatccccggtaaactcccgcagtttatcagggtcatgcctcatattctctctgtcacttacgtgtcactcactggcacccaacctgtgtcttgagcccgatgcatgaagcgctcttggcacctcgctgctcctcccgtcgcttccgcctcttcctcgcccttcaatccgggcagctgatcaaccgataaccccccgcggcgcagatctcatccaacgggtcatcgctcgcaactgagtaaatgtcttaagagcgcttcagccttccttcagggatcatgcctaccatggctacttggctacttttctgtcacagtccattggaatatccggttccttaatatgagcgctactattctagttactccaagctcaggatctgtaagggccgatgctagtattgggaggagttttgttaattgaggatcagcaacttatttggggtgaaa
cgggattgttaccagtaatccagttatgcgactatcaacgtgcgggcttttgcgttacgcggcaaaaatgcgggacgctttccacactactcttcgagagcgcccaaaggtaccatggccttaagagttgctggtcggactgcgcccagtgtctccaactcttgtaaacaaggatctgtgctgatgaccgaaccttgacgacgttgagaccgctcgagacgtttgactaaacaccgcaaaagtcaaagcaataaatgggcagcgcatctgcctgtaaacagcccagcggctcatacaagcgcctttcgctctccgttccagcaaagcagaaggcctccgtcacattccatagagtctgactgtctactcctccctggaaatatgagcttactggcctcccaagaatttgcccgtcgcgtcaaagcaaaatcagcccacccggattacagattccacgccagcacgaattacagacggaagagacttctcaaaggcccgcagtttcaaacagatatgcgccccttcaccgatgcgcaaccgccgcaatgttctcgatagccagactgaactcgcgtccatcaaagggtcggctcactgactccagacgactcccaaagcaaacgatgcagccgctgggctctgaagagtatagaaaaacaaat
agggttccgcgcacatttccccgaaaagtgcaccctgtgtgcgttgggggtgcgtagtcaacaaggtcgccagcaaaattgacaacgaacattg
ccatagttaccagtatctctgctcctgcgagcgtaacgccacaagtgcagcagcagcaagctaagcgcctccaagtcgccccctagaagcagcagtcctcagcaaggaagcaggtgccccatttttgcctgttgccaataatagctgaataataagccactataatcgaactacttttacttataataatagagttgcaaccaaatg
catgcattcatagcacttgcctggggttaagacggagctcccggtgttgccgcgttcattgtccccccgccattggagtagccgttacttatattggctactgtcctt
gacgttattgtaatacagccattaaatcgctgaaatctgacggttcactaaaccagctctgcttacataacctgatgttcaaggatataatcgtgcttgctcaatggtaa
gggcacatacagcgcccggcccagttaccagttatgcactaaaccagctctgcttacataacctgatgttcaaggatataatcgtgcttgctcaatggtaa
atgacgtatgttcccatagtaacgccaatagggacttttccattgacgtcaatgggtggagtatttacggtaaactgcccacttggcagtacatcaagtgtatcatat
gccaagtacgccccctattgacgtcaatgacggtaaatggcccgcctggcattatgcccagtacatgaccttatgggactttcctacttggcagtacatctacgtattag
tcatcgctattaccatggtcgatgcggttttggcagtacatcaagtgtatcatatgccaagttacgcccccctatggacgttagagatcaatacggcaatatgagtcaatatgagtcaatagaaatcaatagaaacttggcatggactatatatatattggcaaccaccgactcccattgacgtcaatggcagctatgctgatgcaccatgactcaattcgccat
tagtcatcgctattaccatggtcgatgtacggtgggaggtctatataagcagagctcgtttagtgaaccgtcagatccgctagagcgcctggattcactgacgtcaat |

TABLE 34-continued

| Constructs | Maps | Sequences |
|---|---|---| gggagtttgttttggcaccaaatcaacgggacttcaaatgtcgtaacaactccgcccattgacgcaaatgggcgtaggcgtgtacgtgggaggtcta
tataagcagagtcctctggctaactagagaacccactgcttactggcttatcgaactcactatcgactcactatagggagaccaaagctggctagcgtttaaactta
agcttgccaccATGagcgtgatcaccatccagtgcagactgtggccaagcagatcctgagacagctgtgggagctgatggccgacaagaaccacc
ctctgatcaacgagctgctggcccaagcacccccagtttgagacatggcgaaacatggccaagcagatcccaccaagctgtgaaaacctggtc
aacagcttcaaggaccagagagattcgcgaccagcagctgacactgctcacctgctgctcgagtctccaagtgtccaagaagttgttcgccctgca
gaagcggcggaagagacagatcgaggcggaacagagtatggcaagagaggatcgacgcagtctgaagatcgacaagagtccagtgagcctgagcgc
catcaggaccaaggccagcctgttccagatctccagcgagacagaccccagatcctctgacagatcgcccattgctccatacctgctgaagaacaactgc
gtccggaagtccagcctgcgcaccggcgtggagaatcaccaagacccaaagatgagaatcagcagcgagaacagcgccgaagaatcagccctaaggcagagg
cagatcagcgagatcgaacaagacaagcagagaattcaccaagagaatcagcagcgaccccaaagatcagcccaagaatcagcgcgatcaggcagagg
atccctaaggcagactctgaccggccagagatgcttcaagatggcctaaaatcagccaccgccaagagcgcccaagaagtagaggatgaagccctgg
caagccctctgctgagaaaaagcgcctgggccaagctgaccggcaagatctactgccgacaagcggtctcgagcactacttcaagcggttctcgaggagctgaagcg
cggcggttcaagcacgtgacagcctcctgccacacccccagtgcttgacctggtggctggagactgttcctggaggaccaagagctgaagctgaacca
aaccaagatcagacgtactgcagcccccgctacactggcggatctctgaccctcgagtgagtgcctcctcggggagcctcctcaagacggaccttcacgaagaagctgcc
gctgcacctgctacgcaccctgacaccagaatgtggacaccagcccttcatcaccagagacagcagcagccagagatcgacgagactgaactgcaaagaaacactgaca
aggccaagcagcagataccgagacctcttatctccgtgggcgtgcctctcggccctgtacagttggacagcgacagcagcgccagcaggcccaagga
tgctggcctacagacgtcagacgcactgaactcatatcggggctctcctccaagaggaccctcgtaaccgcagcagcacatgtcgtctcacgagacacaa
ggccagaagcagaaacgccctaacagcttgcggtaagctcaagctggcccaagacagcagcgaccagcctcaccttggacggccatcagcgcaagcgatc
ccaggccggctcatcgcgcccaagtctgcccaagtcgagactgaagcagcagatcagcagccgacacgcagaagcaggagcagcagagcagatcaa
aagagtctcagcagaagtacgcaaagaataccggataccggcctgcacccggatcagcagcagcctaacagcagcgatcgcagctccaaggc
cggaatctctacagagatcggcaccagccctatccgggctctcccaagagaaggcagagtgctccaggcagcagctgatcgttcgcctaccaaggccgctctgat
gatcAGCCGCAGCCTGCTTACATGTGGCACGTGGAAGAAGCCGACCTGCaaagaagaagcggaagtcggtgc
CTGCCGGCTCTCCTACTTCTACAGAGAGGTTCTTCCTCTGCAGCCcaaagaagaagcggaagtgcggtgc
gggaagcggtgagtaaaggtgaagaactccttcactggaatgctggtgagtgagcgctgatgatgaagcgtgaatagccaaggatgctataattctccgtcaagggcga
aagccgaaggggacgccaacgaattgtgactctgaactgaaatctcatctgacagcggaaactgccccctccatggcctacaatcgtaaccctcacctac
ctgtgcaatctgagcctgagcgtgacatgctaaggatggtgctggcccctctgagcgtagacgtcagcagtgcctagccctgagcgctgaacca
gcccagaagaggggcaaggcggatattgcccgcgacctagcagcagcaagaacctgtcagccgatgtgctcgtcagcagtgctgctctgatctgacgag
tgatggtacatataaaaccggagccaagctaaacagcagctgtatattccaagtaattgaactgatgaaaaggccaacttgaagtctatgcaatattggtctcagacg
ggcacagtggagtaactccaaggcgaacacccttaagcaccgggaaaggcaaaggcgagaatgctgaaatgctgaaagctgattatcgacgag
gcaactctctcaagctgaacactaacctgctgagaaatacctaccggatatcgagcctgagaaatcagcactgtcgctgggcaccgacggctcggaccaactg
attaagagagatgctctcgctctgctcatccggaccaccctgacactgccatcggcagctacgggatgaatcaccaccgagtctcaagatctggaa
gaagaggcttcgcctcgcctgctccagccaagagacacctgaccaagaggggctgaagaaacctgacagaggctgagagcggaagatcgactgtggaca
gatgctgcggaagactcccggaccctcagagtccggagccccatcctcagaagctcccctcctccgggtgctccgggctcctaaggacgactgtgctgactgagtgagaa
ccctgtggggcgagagccagcccatctcggaaaactgcagccccgatcgcagcgatactgagaagctctcgtggctggggaaacatcccagagatccacga
ctggcgcaatgtgagggccccaagctgtcaagcctgctgcccctcctctcctgacagtcatctcctagggcttccctcagccagttctagggcactgcaggcagtctttgctctgagcctgagctgccgtgaaca
gcccagaagagggcaagcggcaccaggcagccaagtcctcggaagcttcctgaagcacacaaacaacctgagcagcaagaccctgcagaagtggaactgtgctgctggagactgtgctgctgatctgacgag
cctgaatctacgatgctgaccaacccagcggccctgagaaggagccaaggatctccgaggatcgctcgctggcaccgacggcctggaacctg
ccaaaaccacctgtataagatacaccctcaaaggcacgacaaccgggcacacccaagctcaaggtgatagttgataaagcagatcacaatgccttctctcaacgc
gtattcacacaagggcgaaggatgccagaggtaccccatgtgagcctggatcgggcctgagtctacatgttagctcaggttaaaa
aacgttaggcccccgaacacgaccacggggtgttttctcacggaactcttcaccgactggatggccatcttggaagctaagagaaggaagtcggtggc
gaagagccgcgtgagtaaggtgaagaactcacttcactggcgactctggaatgtgaaatcaaactcaagaagacataattctccgtcagggggcga
agccgaggggggagcccgaaaatgtgagctaagctggccacttcatctcggcgatacgggacggcaaaccctgagcagcaagacctgtaaatgctaacactgtcaa
gccgtgaagggcgccaacatgaagatcgtctacatccggcaccgcagccaccctgagaaactgccctaggatgccgtataagctgcaggcccctcactac
tggtacataataaaaccggaccaatctgtataccgtgattccgtaagcggcggcaaactgctgaattcatcttgtacgcgtatttagtgctgaggataaaaa
aactgttaggcccccgaacacgaccacggggtgttttctcacggaactcttcaccgactggatggccatcttggaagctaagagaaggaagtcggtggc
ggaagcggtgagtaaggtgaagaactccttcactggctactctggaatgtgaaatcaaactcaagaagacataattctccgtcagggggcga
agccgaggggggagcccgaaaatgtgagctaagctggccacttcatctcggcgatacgggacggcaaaccctgagcagcaagacctgtaaatgctaacactgtcaa
ggccaagtggagtacaacttaacgcgatatataccgctgtattaccgcgtgaagcagaaaatggataaggcaacttaagtccgacataatgtcgaa TABLE 34-continued

Figure 79:
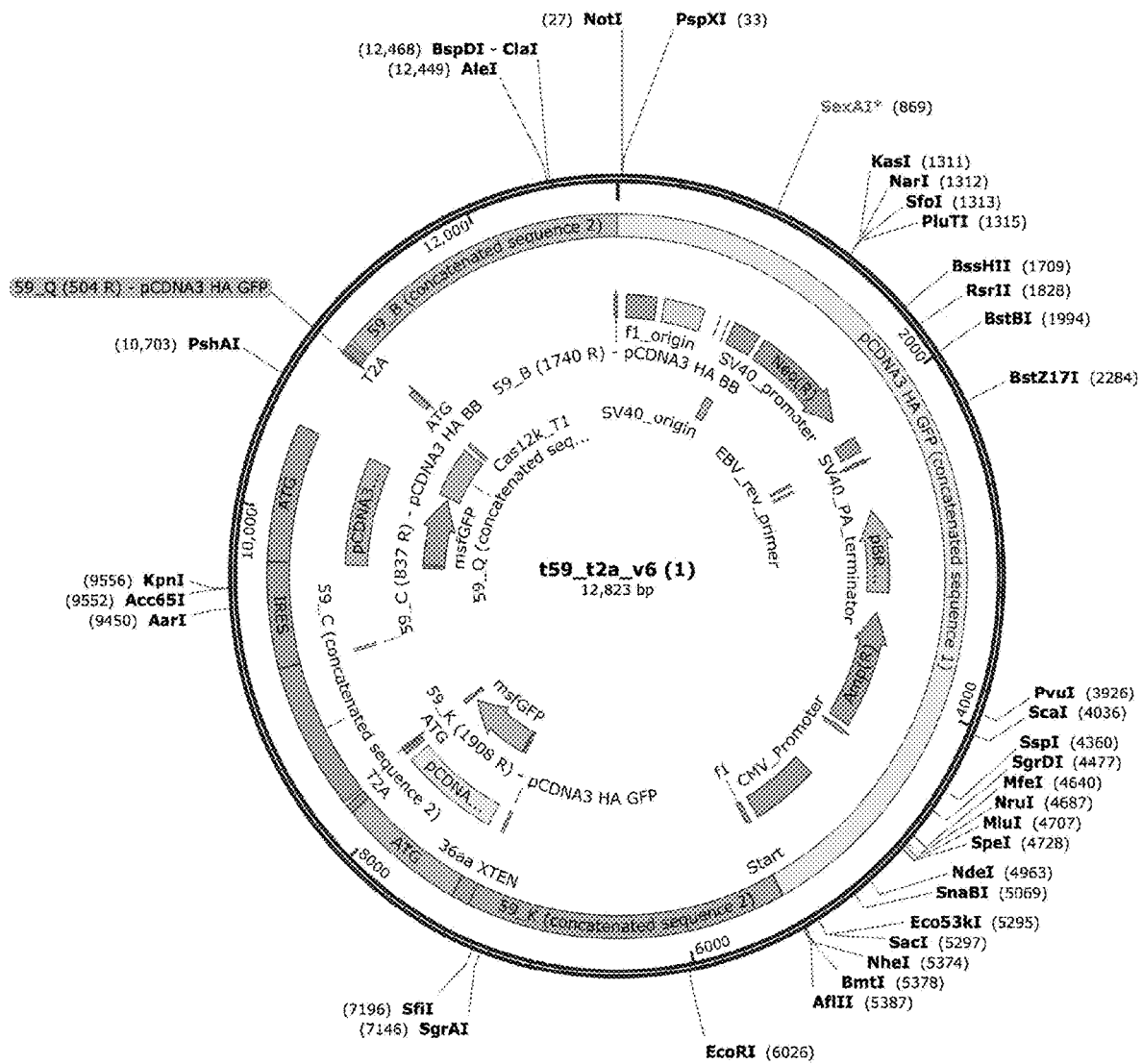

| Constructs | Maps | Sequences |
|---|---|---|
| | | gatggtagtgttcaactggctgatcattaccaacacaaaatacgccatggagatggacctgtactcttgcctgacaatcattatctccacgcaatcaaagctttc |
| | | caaggaccccaaacgaaaagaggaagagatcacatgtccttctgaattgtgactgccaggcatcacctcgttgatgagctgtacaagggagaggagtg |
| | | aagcggagggaggaggaggaggaggagaacgagaatcggagccaggaaccccacattctgaggtggaacctgaaggcgagagctgttc |
| | | actcctggcagattcagaagtgcagattccagacgcgcagctgacacgctggagactggagctgtgtgtccggtggaagaagctgtac |
| | | ttcaaccattccaacgcgcaagagctggaagctgcccgacctgtcaagtgaacgccgatagcggagagtgctgagctgcctctaaggcgtgacca |
| | | tgaagccagaccatcagactgtgccgccgtctatgccgagtgccctcgttacgaaatcgagtggcagtcaagacggagtcgatgaagtgcgaccgcaca |
| | | acctgactgctgaccaagtgcaccaactgcgaccaagaagcaagcttcccccattcctgcgagacaagtcgaatgggtgcaggagtgccctcactgttctgccttgcacc |
| | | atggccaagcggcagaaacacggCGAAGGCAGAGGCCAGCCTGCTTACATGTGCGACTGAAGAGACCC |
| | | CGACCTCcaaagaagaaggcgcggaagtcggtgtgcgaagagctacgagcgacgagagcctgcctgtgaaac |
| | | aacgacgatgtggatgaatccagagacgatgagtggcagacgatgaaagacaaaacgtatcttcaccgactgagcgccagcaagtgaagatgatgattca |
| | | gggcctgctggaactgcgacagaacatcgcgcagcgccatcgcgcgcgagagctggaaacctggaaacgcgacgagcccgagtgacgcagcggcgg |
| | | tcaagaatgtatcagcaggaaccggctgagcgccatcgtggaaacccagagaacgacaaggcagcgagccaggcagcgtgcagaattcatcgt |
| | | gaacaacctccaagcacgatggaagcctgaaggctccaagactgtcaagtcgacaaagctggcctgcagaaat |
| | | ttcccagccacatgaccgtaccgggtgcgaacactgtgaacccctacatcgagcaagcagaacagaaacatcggctggcggccagcagag |
| | | tgtccccaagcaagagatgcccagacatgccagcaatcacgacgtacgacggtacgacggcatcaccgtgcttgatgccctcagctctcagt |
| | | tgtggccgcctcttgccagacacccatctgcctaagcgctcagcgacacctacgagcctggctcacctgagacaacctgttt |
| | | acagacggcagagacttcggaacactcaataccaggatcttctgagccgtcctacggtcagcaactcacaacagagtctggacaataccctgaga |
| | | tcgaggaaagaagcttcggacactgagagctccatctcgtctcgttgaccactcaaacagagctggaccgcccggaccaagaccagacag |
| | | gaggcctgctgacactgaggacggccgactcttctcgttcgcagtgtcaaagatgtcaaagccgacgagctggagcattaca |
| | | attcaagagatggaggcggactgagccagcctcgaacacatcatggcagcacgccaagggccgagaatcgtctgagacatcgagacatca |
| | | aaggcggctatccgagctcgagaacaatcatgggccaaagaggtcctgctgccaagacactactggcgacatcatcttctgtctgaagaacagcattaca |
| | | ccaccgtgggtgtacagaatcgataagggcaaagaggttctcctgcgcaacaagtctatctcggcaacaagttatctctggagacaacagtgcccctgaaagccaagcc |
| | | agccgcctcagaagcgcggaagtgcggagacggggcaagaaccctcatcagcacagcgcgctatcagcctgagcctgctccagcggcatctgggagaccggaccag |
| | | aagtcccagaagcgtgaccagaagcctgaccagaagcccgatcttcaactcacgacgcagcagcgcctcaaactgagcggacaagctatgccgaggactacgagag |
| | | gagacgcaagcctgtgaccaagaagcccgatcttcaactcacgacgcagcagcgcctcaaactgagcggacaagctatgccgaggactacgagctgcaa |
| T59-T2A-V6 (SEQ ID NO: 922) | FIG. 79 | aattctcagatatccagatctccagagccctgagtctgggcgctcgagtctagagggccctcgacctcagtgcctcagcgcatctgtgt |
| | | ttgccctccccgtgctctccctgacctagaagtgccactcccactgtcctcctaataaaatgaggaaattgcatcgcattgtctgagtgtcattctatt |
| | | ctggggtgggtgggcagacaagggaggaggaggatggaaagaacatagcaagcggcgaggcgcattaagcacgcgcgagctctgggcgtagtct |
| | | agaaccagtgggctgggtatcccaagggctccctcctctgccacgtcgccagctcgccaggtctaaatcgggcggccctctaggtccgatt |
| | | cagcgcctaggcgcctcaggcgcctccctcctcgaccccaaaaactttgatagggcatgctatgggagcggcgcattctcgagccatcgcgaagcgtcgcat |
| | | agtgcttacggcgaccttctttcccaacccaaccctcaaccctcccatctctcgacattcggtatatctgattattatagtttcggcctatgttggtaaaa |
| | | cgtctcttattacaaaaatacgcgaattcaaccgcatgatggaagtggaactcgagtcccccaggtcaagcagaagtagcaacaatagt |
| | | atgcattcaatagtcagcaacaagcagtgtgaaagtccccaggccgcccagtccgaagcaagcgcactcttcaattttttattgcagagggcgccgcctctg |
| | | ccctactggctgttcgcatgatgctgaacaagatgatgaacaagttgaacagctccagaagttccaccgttaggagactggcaaaggcgcactactcgccca |
| | | cgcgcggcttcctttcagctgccgtatgcgctcacgtaccagaaggtccatccagtgaaggctcactcgccgaagtccagaagatcagggcaagtg |
| | | ttcgaccaccaagccgaaaatcgcatcgagagcacactggaaggcggtcttgtgaccagtgtgtaccatggggactcgtgccgaatcatgtgaaa |
| | | gccagcgaactgttcccaggctccagcgtgccggctgcggcgctattgtgtgacctatggacacagcccttattcgtgagagcttggcgcg |
| | | tgccgttctcggattcatgctcggtactcggtatcgcgctgacttcgccgagagttcttgaacttcggtgagacctgggttccggacgcg |
| | | aatgggtgaccttctgtgcggtatcgctctgaaggcgcatccgcaccaaactccactcgtatcgccttctgatcaaaaggttcaaataggtta |
| | | tcgaatacagccgaccaagcgaccaagcacgatacggtctcatcaccgagatttcatttgcgccccctctatgaaaggttgggcttcggaatcgt |
| | | gccagcgaactcgccagctcccagcgtcgccatgccatggcgcggcttctttccggaaccttcatcactccggaatgctctcgttcaattaatcatcgaac |
| | | ggcgatgaccaataaaagatttttcactcgcattccagttagtgttgttgtccaaactcatcaatgtatcttatcatgtctgtatcaccgcaatcgc |
| | | tcacacaatcaacgcgctattccttggtggagagttcgatctgcactgagtgccctcaccggatctcgtagacaccgaaagtaagccgggctaatgagtgag |
| | | catggtcatagctgtttcctgtgtgaaattgttattcgcgttcaatcggcccgctcacttagcggtgtcggggtggcctcacggcactcgccggcgttt |
| | | ctaactcacattaattgcgttgccgctcactgcccgtttctgctgggactctggcggcctgcccaaaatacccaccgacgcgcaatactctcaatgtc |

TABLE 34-continued

| Constructs | Maps | Sequences |
|---|---|---|
| | | gcgtattgggcgctcttccgcttcctcgctcactgactcgctgcgctcggtcgttcggctgcggcgagcggtatcagtcactcaaaggcggtaatacggttatc |
| | | cacagaatcagggatacgcaggaaagaacatgtgagcaaaaggccagcaaaaggccaggaaccgtaaaaaggccgcgttgctggcgtttttccatagg |
| | | ctccgcccccctgacgagcatcacaaaaatcgacgctcaagtcagaggtggcgaaacccgacaggactataaagataccaggcgtttccccctggaagctc |
| | | cctcgtgcgctctcctgttccgaccctgccgcttaccggatacctgtccgcctttctcccttcgggaagcgtggcgctttctcatagctcacgctgtaggtatctcagt |
| | | tcggtgtaggtcgttcgctccaagctgggctgtgtgcacgaaccccccgttcagcccgaccgctgcgccttatccggtaactatcgtcttgagtccaacccggta |
| | | agacacgacttatcgccactggcagcagccactggtaacaggattagcagagcgaggtatgtaggcggtgctacagagttcttgaagtggtggcctaactacg |
| | | gctacactagaagaacagtatttggtatctgcgctctgctgaagccagttaccttcggaaaaagagttggtagctcttgatccggcaaacaaaccaccgctggta |
| | | gcggtggtttttttgtttgcaagcagcagattacgcgcagaaaaaaaggatctcaagaagatcctttgatcttttctacggggtctgacgctcagtggaacgaaaa |
| | | ctcacgttaaggggattttggtcatgagattatcaaaaaggatcttcacctagatccttttaaattaaaaatgaagttttaaatcaatctaaagtatatatgagtaaacttg |
| | | gtctgacagttaccaatgcttaatcagtgaggcacctatctcagcgatctgtctatttcgttcatccatagttgcctgactccccgtcgtgtagataactacgatacgg |
| | | gagggcttaccatctggccccagtgctgcaatgataccgcgagacccacgctcaccggctccagatttatcagcaataaaccagccagccggaagggccga |
| | | gcgcagaagtggtcctgcaactttatccgcctccatccagtctattaattgttgccgggaagctagagtaagtagttcgccagttaatagtttgcgcaacgttgttgc |
| | | cattgctacaggcatcgtggtgtcacgctcgtcgtttggtatggcttcattcagctccggttcccaacgatcaaggcgagttacatgatcccccatgttgtgcaaaa |
| | | aagcggttagctccttcggtcctccgatcgttgtcagaagtaagttggccgcagtgttatcactcatggttatggcagcactgcataattctcttactgtcatgccatc |
| | | cgtaagatgcttttctgtgactggtgagtactcaaccaagtcattctgagaatagtgtatgcggcgaccgagttgctcttgcccggcgtcaatacgggataatacc |
| | | gcgccacatagcagaactttaaaagtgctcatcattggaaaacgttcttcggggcgaaaactctcaaggatcttaccgctgttgagatccagttcgatgtaaccca |
| | | ctcgtgcacccaactgatcttcagcatcttttactttcaccagcgtttctgggtgagcaaaaacaggaaggcaaaatgccgcaaaaaagggaataagggcgaca |
| | | cggaaatgttgaatactcatactcttcctttttcaatattattgaagcatttatcagggttattgtctcatgagcggatacatatttgaatgtatttagaaaaataaacaaat |
| | | aggggttccgcgcacatttccccgaaaagtgccacctgacgtcgacgtcgagcggatcggaagagcgccgtaaaaggctggtcactccactcgtcctgatgc |
| | | cgatagtcaagccagtatctgcctctccgttctgttgaggtctggggtcctgatgtcgcgagcaaattaagctaacaacaggcaaggtcaagcttgaccgacattg |
| | | catgaagaatcgttcttaggcgtttaggcgttgcgcgtctacataactacggttcagatatacgttgacatgttattgactgcataacg |
| | | gggcattagttcatagcccatatatggagttccgcgttacataacttacggtaaatggcccgcctggctgaccgcccaacgacccccgcccattgacgtcaata |
| | | atgacgtatgttcccatagtaacgccaatagggactttccattgacgtcaatgggtggagtatttacggtaaactgcccacttggcagtacatcaagtgtatcatat |
| | | gccaagtacgccccctattgacgtcaatgacggtaaatggcccgcctggcattatgcccagtacatgaccttatgggactttcctacttggcagtacatctacgtat |
| | | tagtcatcgctattaccatggtgatgcggttttggcagtacatcaatgggcgtggatagcggtttgactcacggggatttccaagtctccaccccattgacgtcaat |
| | | gggagtttgttttggcaccaaaatcaacgggactttccaaaatgtcgtaacaactccgccccattgacgcaaatgggcggtaggcgtgtacggtgggaggtcta |
| | | tataagcagagctctctggctaactagagaacccactgcttactggcttatcgaaattaatacgactcactatagggagacccaagctggctagcgtttaaactta |
| | | agcttgccaccATGagccgtcaaccagctgctcgacactgcagcgccgctctccaagtctcgtgggtggtgctggcccaagctgtgcagcaagaacccc |
| | | ctctgcttcaaccagctgctgccaagcagctcaccccaagtggaaagccccaagtgggaagcatggtgacaaaggcagaatccccaccaagctgtgaaaacctggtc |
| | | aacagcttcaagacccaagagagatcgccgaccagcccgagattctacactctcgaagcctgacaaccctgaggtgcaaggtggttcgccctgca |
| | | gaagcggcgaaggacagatcgaggcgcaacgcaggtccaccctcagcgtgcaaaagagacagaccagcccgaaagaccaagaagaccaagagtccagctgagccgcc |
| | | catcaggaccaaggccaagatcccagctccaggtgttcaagatcctcagatcctgtgaacaaccacgagagccagaccccagagatgtgcttgacctgctacctggtgc |
| | | caggaccaagatcccagctcctgaagatctacaaagatgctggctgcctgcctgcaaagatgcccccagacccaaggtccaccatccgaagccaaggtgaaccctgtt |
| | | atccctagggcacgctctgagaaaaggccgacgtgccagctccattcccgctacagagcaacactccagagaccgtcactactcaagtgcaaggcagcgg |
| | | caagcctctctgaagaaaagcgcgaacgcgactcgctcaactctgatcctgctgcgacaagcggcactacttcaagcctagcgacatcgcagtggagtggag |
| | | aaaccaagaacgtgctacgaggcagccctcccgttctaccatcgtcttaccagccgcggcagcaatgggcccagaagtgcatcacccgtgctggactgcttctgcat |
| | | ggagtttttctgagcaagctcaccgtggacaagagcaggtgcagcagcaatgggcagaagtacggtacggtgggaggtcta |
| | | tataagcagagctctctggctaactagagaaccccactgcttactggcttatcgaaattaatacgactcactatagggagacccaagctggctagcgtttaaactta |
| | | agcttgccacc |
| | | AGCGGCAGCGAGACTCCCGGACCTCAGAGTTCTCCTGCAGCCcaaagaagaagcggaagtcggtgc |
| | | ggaagcggcgtagtaagtaagggaagactcttcactggagtagtgccattcggatgagagcgtgatgagattctgagagatctaaatgacataaattctccgtcagggcga |
| | | aggcgaaggggacgccacgaatgttaagtctgactctgaactcatctgacgcggcaaactgccctactactcgtaacgacccttaacctac |
| | | ggcctgcaatgctttttccgatccgaccaacagcatgactttttcaagctgcctgaagtctagtttcagaaggaccatcagcatgtcagcttaagga |

TABLE 34-continued

| Constructs | Maps | Sequences |
|---|---|---| tgatggtacatataaaaccgacgaggttaaatttgaaggggacactctgttaatcgaattgaactgaaggtattgatttaaggaggacggtaacatactg
ggcacaagttggagtcaactttaacagccataaccacaaatacgcccatggagatggaccctgactctgcctgataagcagaaaatgggataaaaagccaacttaagatccgacataatgtcgaa
gatggtagtgtcaactggctgatcattaccaacaaatacgcccatggagatggaccctgactctgcctgacatcattatctccacgcaatcaaagctttc
caaggaccaaacgaaaagagagtcacatggctccttctggatttgactgccgcagcagtcgcgagcccattctcgatgatgagctgtacaagGAAGGCA
GAGCAGCCTGCTTACATGTGGCGACGTGAAGAGACACCCGGACCTCaaagaagaagcggaaggtggtg
gcgaagcggcaggacgactactggcagagatggtcagaactgggcgacgagccattcctgaagaactgcagccgatcgagagactgc
tagccctctcgtgatggaactggaacacatccagagatccaccgactggcggtgctgaacaagccccagaagccggtctaagcagtgctaagcggcagaattgtgccgtgctgatgcaggtcc
agccggcaagagcgtgaactgtacggtgacggtgctgaacaagcccgaggacgtgatcctgcgaagaaggggatattgtgcggtgcctgaagaagaagtgcag
ccgggatgtcctagcggagaactgcgtggtgctgacggcggaaagctgaaatgtcgatatcgacgaggaccaacctcctcaagctgaacacctgacgaccgctga
cgcctgctgaaagaaagcaaggtggaaatgtgaaatgtcttaatcgacaactggagcctgtaatcaacctccagccccgattcctcagtgccctgcctgt
gatcagcatcgtgcctgtgggcaccacgctgtgactgcaacctgattaaggagaaggaggtgctctgctctgcctagcaacctgaccagagcgagaactgaac
ggaaagcggagaagaaattcaacgaacgctggtcaagatcggaagaaggaggcggtgacgggctctgacctgctctgcctagcaacctgaccgaagaatcgacaa
cctggacgaagaaacggcgagaagcggcgaggttgacgaggagatatcgaattggatccgcctcgaagggcctgaagaatcgacaa
agaaacctgaccgaggtgctggttgcaagcgtcagatcatggagcactagggcggccccctgggccgagcctcctttgcatgaggcccgaaactggccctcgtttgacagcattccaagg
ggtcttcccctccgcaaggaatgcaaggctcgtgatgtcgtgaaggaagacgctgttcctcgaagcaaacaacgtcgtagcgaccctttg
gcaagcacgacgccccaccctggcgctctcgcggcaaaccagcgtgtataagataaggaactgaccaagcccaagt
tgtgagttggatagttgtggaagagtcaaatggctctccctcagactcaacaagggcgaaggtgcccagaagtgcccagaaggtgcccattgatct
gggccctcggtacacatgctttacatgttagctcgaggttaaaaaaatctaggcccgaaagcgcgtgagtgaaggaccgcgtgactcttcactggagtagtgccattctggta
gagcttgatgagagtgaaatggacatatttctccgtcaggacgacacccctgcaatgtgccctcaggggagggccagggatgtaagctaagtgactctgaaaccatgactctttcaagtc
gcaaactgcccgtccaaggcgagagtctaacgacccactcagcttaaggatgatggtacaactactgggccaagttggaggactgtataagctgactctgtatagggggcactctggttaat
tgcaatgcctgaagttatgtcaaggaaggaccatcagcttaaggaggtaacatactgggcagttggaacatactggaagtacaacttaacgccataatggtatattaccgctgataagc
cgaattgaactgaaggttgattttaaggaggtaaagcccggtggggaccggctaacatgtgaagtacagaatgggccataccaacaaatatgcccatggta
agaaaaatggataaaaagctcaactgaagtccgacaatcattatctccacgcaatcaaagctttcacaaagcaaaaagaaatcacaacaaatacggcccatcggagatgga
cctgtactcctgctgacaatcattatctccgcgcaatcaaagctctgtcactggtgctgatcattaccaacaaatacggcccatcggagatgaattttgactgccgc
agcatcactctcggtatgatgagctcggtacaaggaagagggtacaagggaggaagcggaagcggaaggcgaagggcgagcgaggaac
cccacacttccaggtggaactcggaagccgagagcctgtctccttgctacttccaacccattccaacactgggcagataagaaacaacgcgagaagagaactactgacccagcagccagctggcaagc
tgacaggactggagctggtgtccgggtgaagaagatttcctgccgctactcaagtcaaggggagccgagcaaggactcagtgaa
cgcgatgaggtgcgcgagatgctgccctcaaggcggtgctgaccggcaaccctctcagacggcgcgccttatccgaagtgccctgtcacagaatcagcagcaattcagcggcgagatgctgccctcaaggcggtgctgaccggcaaccctgtcagtgcgccttatccgaagtgccctgtcacag
aatcagtggcagttcaaggacgtgatgaagtcgaccggcacaaactgactgctgaccggcaagtgcgagacaagcttccccattcctgcga
atggtgcaggcgagtgccctcactgctcttctgcccttgccaccatgccaagcggaaacacggcGAAGGCAGAGGCAGCCTGCT
TACATGTGGCGACGTGAAGAGACACCCGGACCTccaaagaagaagcggaaagtcggtgcgaaggcggcgacgagtg
cccatcgtgaagctcaggcgaggacaggagcgcctgctgaagacaagcggcgatgagtcagcgagcgatagctgagctgtgaagacaaacgtgatcttcac
cgagctgagcgccgaggccaagtgaaagcggtgatgtgattcaggcgtcagggcgagatacgcgagagctgagctgcgagtggccg
cagaaactggaaagacagctggcgagcagacaggagcgagcgagcctggtcaagaagtactcaggcgcatcagggcgagatacgcgacagaaacgacaa
gcagtgtcaccctggcgcgcatgaaggcagagatctcgcagatcgtgtcaaaagcagcgagccaaggactcgctcaaggagtgaccccctgcgagcgct
gcagtgtcaccctggcgcgcatgaaggcagagatctcgcagatcgtgtcaaaagccagcgagccaaggactcgctcaaggagtgaccccctgcgagcgct
tgagagtccaagtcggctgacagcggacaagccgctgctgcagatcgctgcagaatttcatcgtgaaccacctcaaagaggaccacctcaaggggctcaagttgacccgagcagcctgcgctcaggctgtgatccctcatcgtccgcaagagcggaaagatcaagagatggcagaccagccaacaggatgctcaaatggtggaataccgctgtggcagccaacatcgcgctggccaaggaaatgctgcagtgcgagaagcggcagaagacatctcagcgctgctcgagtgacaactgcatatcagtggcaga
aagcagaagcagagaacatcgcgcagacaactgcaagcagaccaaggaccaagacagcaagccctcgggcagcaagacagcaagaaactgtcccacagaaagcaaccctcgaggagatcaatcctagaggcagcctcaaggcctgacgctgtacgctgactggagggccagcaagcctcggtt
cagtgccaccaccaagcatcggtcagctgagcttcctgctcctggagctcattggcccctaggggcagcctcctttatcaaggcccatcggaccagtacagcgtagatgctcagccgcactgcaagcaaaccgcaagcagtgctcaggagcctgccgagggc
atcatggacgctcaccggcgctgggcctttgatgccctagcctgtcagcctgccaatcatggcctgcggcgacccatacccatcgtcagcaagatcctgcaacctgtctgacactgagcagttcagcagaacatcataccgggtctacggcttcctacggcctcacc
ttcgagtgcaactccaagatccgagaagcagagaccacgcccgaagcgcatcagagcgagatggcgatcctgagagtgctgcgagccttctcgccgagctgaggtctggagagttacgcagaggccaagaagcggtcttcctgtcgcgccacct
gggccagcaacatccaaggagaggaagaacagcccgaggacgcagaggccctgctgacaactggcagtgctggcgagccttgcgctcgtgcgctacgtctgaatggcatcgtctgaccgccaagaggccgcagc
acaaccagagcggctgacaaccaaggaccaagacagcaagacaggcaagcctgcacgcgagtgggaggccggaatcgcagccgttacgacaactgtcagcagatctcaagcgcgatggctcaaagacgccaagaagcgccgccgcgc
tgaacattgcctgatgaagaaaaaccgggcccctgagaaaagagggttcattacaaacgcggccattgctccagctgacctgcgctgagtcgatgcttgagatccaacctgtacgctgcctgcatacctgccgctatgc
cgcgagaatctgtgcgagatcgagagaacagcgctacagacatacagacacccagcaccctccttgagaaaagcaagaggaactgatgcgcgatcaggagaaaggggtgctcttctgcggaacttctgagaaagcggaagatcaacttacctcgccgacctc
gggcaacacatccaaggaagaagagacccgaggacagaggcctcaactgacactgagagctgttacactgccggatgtgccccacagctggttcagaaagaaagtcccggcccacttaaccgcagaggtgggccaagacccaaggccagaccaatctatcctgg
tgcaatctgcctgatgaagaaaaaccgggccctgatgaacagagggcattcaccaacgcggccattgctccagctgacctgcgctgagtcgatgcttgagatccaacctgtacgctgcctgcatacctgccgctatgc
cgcgagaatctgtgcgagatcgagagaacagcgctacagacatacagacacccagcaccctccttgagaaaagcaagaggaactgatgcgcgatcaggagaaaggggtgctcttctgcggaacttctgagaaagcggaagatcaacttacctcgccgacctc
ctgattgggacagacaactgcgagcacccttatcaagcagaagaagacctgcaagagactggtgtacagatgctacgacgagtcaagggtgtggcaagcccgagcaacaagccgcgagcaaccagtccgcccacccaggttcaactacggacaagt
acaaccagagcggctgacaaccaaggaccaagacagcaagcggcgcgcatgaagaagtggagaagggcatcgcagccgttacgacaactgtcagcagatcctcaagcgcgatggctcaaagacgccaagaagcgccgccgcgc
cgcgagaatctgtgcgagatcgagagaacagcgctacagacatacagacacccagcaccctccttgagaaaagcaagaggaactgatgcgcgatcaggagaaaggggtgctcttctgcggaacttctgagaaagcggaagatcaacttacctcgccgacctc
ctatcaatctgagcgagcagagacccgaaaccgtgaccaagactcaagaaaacctgaccgaccgagagctgcttcaactacggacagctgcggcag
gactacgagtaa TABLE 34-continued

Figure 80:
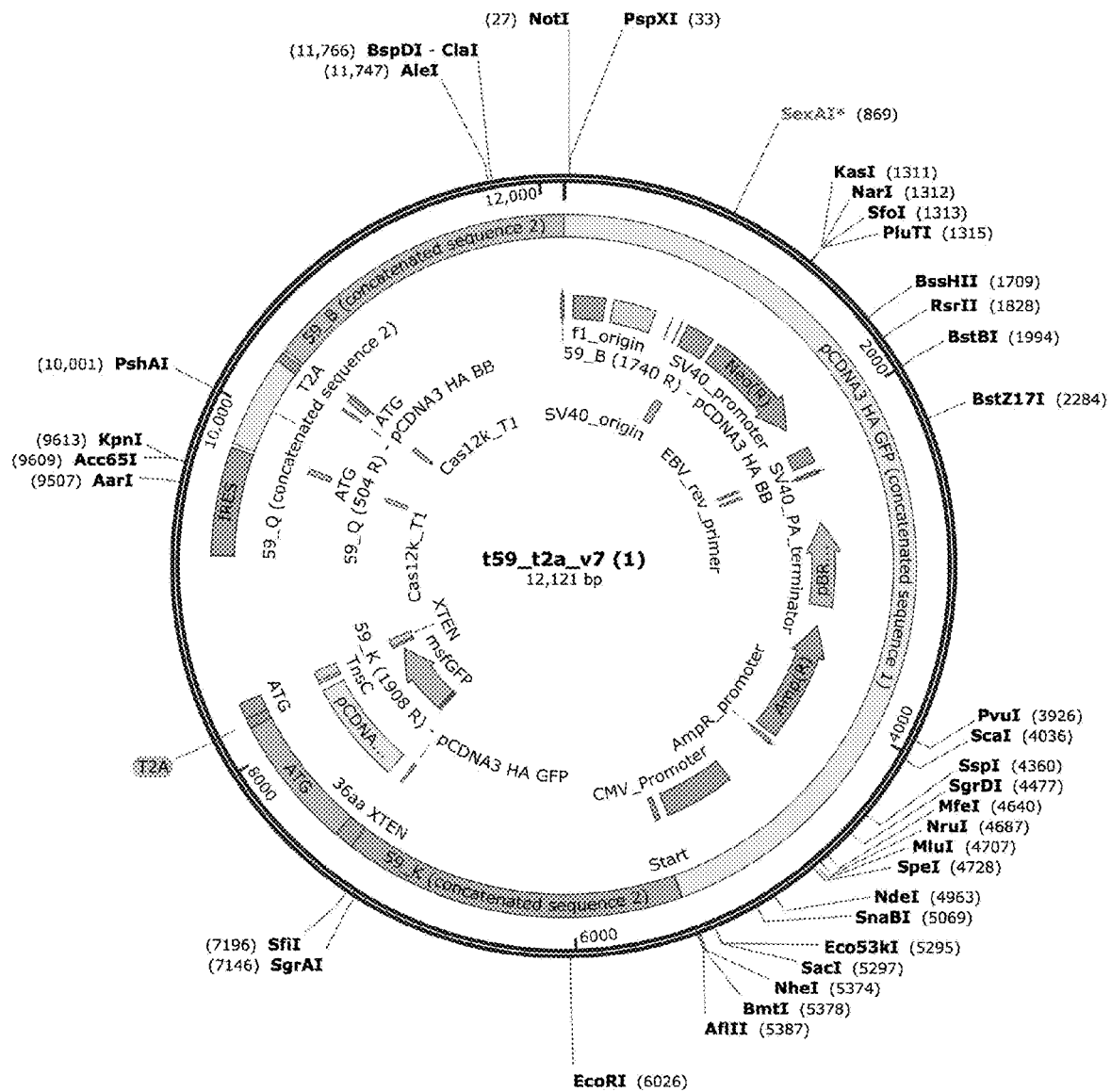

| Constructs | Maps | Sequences |
|---|---|---|
| T59-T2A-V7 (SEQ ID NO: 923) | FIG. 80 | aattctcagatatccagcacagtggcggccgctcagtctagagggccgctcagtctgatgtgcttctagttgccagcatctgtgt<br>ttgccctccccgtgcttcttgacctggagcagcaggtgccatcccactgtccttcctaataaatgaggaaattgcatcgcattgtctgagtagtgtcattcatt<br>ctggggtgggtgggggcaggacagcaaggggaggattggaagacaatagcaggcatgtgctggggatgcggtgggctctatgctcttctgaggcgaa<br>agaaccagctgggctcaggggtatcccaaggctagcgcgctgtagcggccgcattaagcgcggcgggtgtggtggttacgcgcagcgtgaccgctacacctgc<br>cagcgccctagccgcccgctccttcgcttcttccctcctctctccgcacgttcgccgcttccccgtcagctcgcggctggcctcaaatcggggctccctttaggtccgattt<br>agtgcttaacgacgcccaccctgactccgacccaaaaacttgattaggggtgatggttcacgtagtggcatcgccctagccggggcttttcgccttttgacgttggagtcca<br>cgttctttaataatgtggactcttgttccaaactggaacaacactcaaccctatctcggtctattctttgattttataagggattccgattccggcctattggttaaaaa<br>tgagtcgattttaaacaaaatttaacgcgaattttaacaaaatattaacgcttacaatttccattcgccattcaggctgcgcaactgttgggaagggcgagatgcaaagc<br>atgcatctcaattagtcagcaaccaggtgtggaaagtccccaggctccccagcaggcagaagtatgcaaagcatgcatctcaattagtcagcaaccatagtcc<br>gccctaactccgcccatcccgccccctaactccgcccagttccgcccattctccgccccatggctgactaatttttttatttatgcagaggccgaggccgcctctg<br>cctctgagctattccagaagtagtgaggaggctttttttggaggcctagggcttccggtctctatatcctttggatctgatcaagagaca<br>ggatgaggatcgtttcgcatgattgaacaagatgggattgcacgcaggttctccggccgcttgggtggagggctattcggctatgactgggcacaacagacaat<br>cggctgctctgatgccgccgtgttccggctgtcagcgcagggcgcccggttctttgcagcgcatcgccttctatcgccttcttgacgagttcttctgagcggggactctggggttcgaa<br>atgggctgaccgcttcctcgtgctttacggtatcgccgctcccgattcgcagcgcatcgccttctatcgccttcttgacgagttcttctgagcggggactctgggt<br>tcgaaatgaccgaccaagcgacgcccaacctgccatcacgagattcgattccaccgccgccttcattgcatcgcattgtctgagcgcattcgccttctatcgccttcttgacgagttcttctgagcggggactctgggt<br>ggtggatgatcctccagcgcggggatctcatgtgagttcatgctggagtctgttgtgttgtccaaactcatcaacaacacgacgacccaaactgttattcatgatgctgctatatcgtgatcctagttagagcttggcgtaat<br>tttcacaaataaagcattttttcactgcattctagttgtggtttgtccaaactcatcaacacgagccggaagcataatgatgaagtgtaaagctcggaagtgtaaagctgggtgccaatgagtgag<br>ctaactcacattaattgcgttgcgctcactgcccgctttccagtcgggaaacctgtcgtgccagctgcattaatgaatcggccaacgcgcggggagaggcggttt<br>gcgtattgggcgctcttccgcttcctcgctcactgactcgctgcgctcggtcgttcggctgcggcgagcggtatcagctcactcaaaggcggtaatacggttatc<br>cacagaatcaggggataacgcaggaaagaacatgtgagcaaaaggccagcaaaaggccaggaaccgtaaaaaggccgcgttgctggcgtttttccataggctcc<br>gcccccctgacgagcatcacaaaaatcgacgctcaagtcagaggtggcgaaacccgacaggactataaagataccaggcgtttccccctggaagctc<br>cctgcgtgctctcctgttccgaccctgccgcttaccggatacctgtccgcctttctcccttcgggaagcgtggcgctttctcatagctcacgctgtaggtatctcagt<br>tcggtgtaggtcgttcgctccaagctgggctgtgtgcacgaaccccccgttcagcccgaccgctgcgccttatccggtaactatcgtcttgagtccaacccggta<br>agacactatcgccactggcagcagccactggtaacaggattagcagagcgaggtatgtaggcggtgctacagagttcttgaagtggtggcctaactacg<br>gctacactagaagaacagtatttggtatctgcgctctgctgaagccagttaccttcggaaaaagagttggtagctcttgatccggcaaacaaaccaccgctggta<br>gcggtggtttttttgtttgcaagcagcagattacgcgcagaaaaaaaggatctcaagaagatcctttgatcttttctacggggtctgacgctcagtggaacgaaaa<br>ctcacgttaagggattttggtcatgagattatcaaaaaggatcttcacctagatccttttaaattaaaaatgaagttttaaatcaatctaaagtatatatgagtaaacttg<br>gtctgacagttaccaatgcttaatcagtgaggcacctatctcagcgatctgtctatttcgttcatccatagttgcctgactccccgtcgtgtagataactacgatacgg<br>gagggcttaccatctggccccagtgctgcaatgataccgcgagacccacgctcaccggctccagatttatcagcaataaaccagccagccggaagggccga<br>gcgcagaagtggtcctgcaactttatccgcctccatccagtctattaattgttgccgggaagctagagtaagtagttcgccagttaatagtttgcgcaacgttgttgc<br>cattgctacaggcatcgtggtgtcacgctcgtcgtttggtatggcttcattcagctccggttcccaacgatcaaggcgagttacatgatcccccatgttgtgcaaaa<br>aagcggttagctccttcggtcctccgatcgttgtcagaagtaagttggccgcagtgttatcactcatggttatggcagcactgcataattctcttactgtcatgccatc<br>cgtaagatgcttttctgtgactggtgagtactcaaccaagtcattctgagaatagtgtatgcggcgaccgagttgctcttgcccggcgtcaatacgggataataccg<br>cgccacatagcagaactttaaaagtgctcatcattggaaaacgttcttcggggcgaaaactctcaaggatcttaccgctgttgagatccagttcgatgtaaccca<br>ctcgtgcacccaactgatcttcagcatcttttactttcaccagcgtttctgggtgagcaaaaacaggaaggcaaaatgccgcaaaaaagggaataagggcgaca<br>cggaaatgttgaatactcatactcttcctttttcaatattattgaagcatttatcagggttattgtctcatgagcggatacatatttgaatgtatttagaaaaataaacaaat<br>agggttccgcgcacatttccccgaaaagtgccacctgacgtcgacgatcggagaggcggataacaatttcacacagga |

TABLE 34-continued

| Constructs | Maps | Sequences |
|---|---|---|
| | | tataagcagagctctctggctaactagagaacccactgcttactggcttatcgaattaatacgactcactataggggagacccaagctggctagcgtttaaactta |
| | | agcttgccaccATGagcgtgatcactccagtgcagctgcagactggtggccagactggacacccgagacagtcgtggagctgggagctgatggccgacaagaacccc |
| | | cctgatcaacagctgctggccaagctgggaaagcaccccagtttgagacatggctgcagaatcccaccaagctgctgaagacctggtc |
| | | aacagcttcaagaccaagaccagagaccttcgccgaccagcctgcagattctacacctctgctcgtggactacgtgtcaagagttggttcgccctgca |
| | | gaagcggcgaagaacacagatccgagggcacaaagagaagatctttcaccctcgagcctgaacctgaactgaacaagacgcccagtgagctgagccgcc |
| | | catcaggaccaaggccagctgtccagatcctgtgaacaacagtcaccccagagcgagcagaaccagcagaggcccattgctacttgcctactgctgaagaacaactgc |
| | | gtccgagaagtccagctggacgaggacagcgaggaattcaccaaagagattgagatcgagctgcaagaatcagctgcagcagg |
| | | atccctaagggcagaagctgaccgccggcgaggattggccaagcctcaagcctgtccgagaacctgaagaccgagaagaagcaaggcctgg |
| | | caagccgctctgtcaacgggcctgggcaagctgacctcccctgttcacctcggagtggtagaactgcttggagacccctggaggtttctcgaggaccaagagctgaagcgg |
| | | aaccacaagaatcagtacagcgagctccctgtcaccctcggagtggtagaactgcttggagacccctggaggtttctcgaggaccaagagctgaagcgg |
| | | gctgcagctacctggacctcgaccagaccagagaacagtgacctggtaccatccagagccaccagcaccagcatcaacgaaccctgaca |
| | | aagccagcagcagatacccaggccagccttctatcctcgtgggcggaactacaatcgctggaaccggcgcacagccagcagagagatctctcacgagatgagg |
| | | gcaagagcccacgaagccgccgaactctgttcgccggagaactacacagttgagagcgagctcagagccgagagctctacagagacgagagcagagtgctccaagaccccgaggaggagaaccggcgagctcagagccgagagctctacagagacgagagcagagtgctccaagaccta |
| | | ggcccagcagaaacgccccttaacagctgctgacagctcgtcgagcggcatcattgccattgccaagacata |
| | | ccaggccgctccatcgctgctgccaagctgccaaagaatacgatgagcgtgcaccgtgtcctccaagaggaagcagatgtgccgtgctcctaccaagaagaccaggccgctct |
| | | agaggtcagcagaagtacgccaaagaataccggatgagcgtgcaccgtgtcctccaagaggaagcagatgtgccgtgctcctaccaagaagaccaggccgctct |
| | | cggaattctacagagatcggcaccccagctccggctgctcctccaagaagaccagatgtgccgtgctcctaccaagaagaccaggccgctct |
| | | gatcAGCGGCAGCGAGACTCCCGGACCTCAGAGTCCCCACACCGAAAGTGACCTGGATCTC |
| | | CTGCCGGCTCTCCTACCTTCTACAGAGGAGAGTTCTCCTGCTGCAGCccaaagaagaagcggaaggtcggtgc |
| | | ggaagcggcgtgagtaaaggtgaagaactcttcactggagtagtgcccattcggagtgagagttgatggagatgtaaatgacataatttccgtcagggcga |
| | | agccgaagggacgccacgaatggtaagctgacctctgaaatcatctgtacgacgggcaaatctgccatggcctctacactcgtaacgaccccacctac |
| | | ggcgtgcaatgtcttttccgatatccccgacccaccatgaaagctgaaacagatgacttttcaagtctgaagaaaggaccatcagcttaagga |
| | | tgatgtacataaaaccgaccgaggttacaacttttaaatttgaagggaacactcggttaatcgactgaagtgagactattgattttaaggaggacggtaacactg |
| | | gggcacaaagttgagatcaacttaacagctacagcagccatggcagcactgttactattgaccgtcgataagcagaaatggaacaactttaagatcgacataatgtcgaa |
| | | gatggtagtgtcaactggctgatcattaccaacaaataccccatcggagatggaccctgactctctgctgatcaatcattcctctccagcaatcaaagcttc |
| | | caaggaccccaaacgaaaagaggatcaacatggtcctctgcgacacctgaccctgaccgtcaaggcctgtcgaaaaagaaaaaagaaatcagacaaaccgagcctggtcaaga |
| | | GAGGCAGCTGCTTACATGTGGCACGTGAAGAACCCGACCCGGACCTCcaaagaagaagcgg |
| | | gcagcgaactcccggactccagagtccgcgcacaccagaagtccgccaaggacctcctgcaggcacctacgggagtcctggtgtcaagacgactactgcagaagtggtcagaa |
| | | cctgtgggcgacggccgcagccatctcctgagaactgcagccgcagagtgtgcccagaagctgagcctctgtgtggagagcgtgacctgtgaagaccatccagaagatccacga |
| | | gcccaagagacagttcggtccagcagacgtgccaaggtgcgccgcagcatctgctcaggggacccgacagaagatgtgcctgcgtatgctctgtcctcctgaaag |
| | | cctgaagtacgacatgcgccaagctgaaacccttcagcccagcgaagaccttacagagccacagtgctgcaagtgtaagtggaatgcaagttcaatggcctctcccaagc |
| | | gcaacttcctaaggctgtataagatacaccgggacgtggaccgcagccggatacccctcccatgctgtatggggaccactcagcacaccgagaagaagag |
| | | acgtcaggccccgaacctggagcggaacagctgccccatcttcctttgaaaacacgatgatatggccacctgaaacaatggaagaagcggaagtcggtggcc |
| | | gaagctcgaattggagagccctcctgtcccccggaaaagctggctccctttactggcccgctctcttctgaaaaggcggtggatgagcgctgcagcagatcgga |
| | | ctacctgaccagcagcagtcaacccctgactggccaggcgacaggccgatagacgtggagctgggcgatgtccgtgaccgcagttctacctaaggctgggcccatgcccatggatggttcccagggagtccg |
| | | gcgccctgtatgccgagtggagatctgtccacggccccgcgagcacaaccgctgtgtgcctgtagtgcctccaagggcgatgaagaacgctgattgtgaaaagatccaaggctgtcggcgcccatgccacgacggaaagtgcaatggcctcctcccaagc |
| | | gaaggagccacgttggtagatacaccgcaaaggcgcacaaacccattctgatgccagaaggttaccatacctgtatgggcctcgtattgatatggcccaactgtgacacatgtttacatgtttagtcggttaaaaa |
| | | aacgtcaggccccgaaatcgagcgggaaaccccatcttccgttgaaaaacacgatgataatggccacctgaacaatggaagagcggaagtcggtggc |
| | | actacctgaccagcagcaagctgctgcaggacgcaggcggacgcagtcaagctgttggtctccggtgcagcgatgcagtcaagcggagaactgcaagggagcggggacaaacctggcaagagccagaagagaagagcaaggcatcatcatccgtaccgagcagtccagcttttatactggattttagtcagcgagttcggttaaaaa |
| | | ctgaagccctgtatgcgagatggaatcgactgagcggtgcctgccgtgatgcggagctgcctccaagggcgatgaagaacgctgattgtgaaaaga |
| | | aactgcagagaagctgccgcagacctggctggctcctctggctctgtctgccgaatggtcaggcagtgcagggctgcaggacccgtgcagcagagcgagg |
| | | GAGGCAGAGGCAGCCTGCTTACATGTGGCACGTGAAGAAGACCCCGACCCTCcaaagaagaagcg |

TABLE 34-continued

Figure 81:
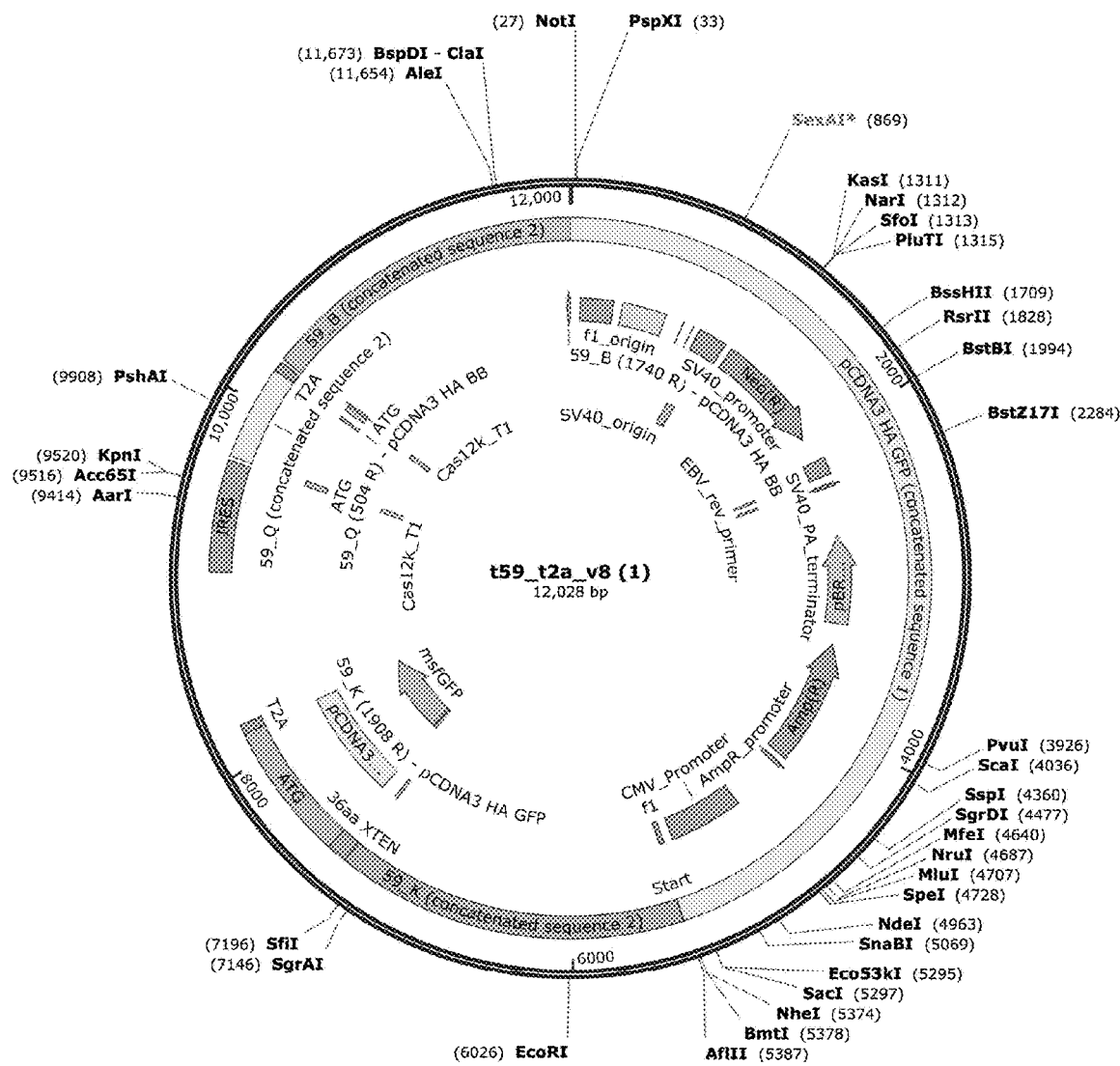

| Constructs | Maps | Sequences |
|---|---|---|
| | | gaaggtcgtggcggaagcggcgacgatgccatcctgaagcaggacgagagcctgctgtgaaacaacgacgatgtggatgagatccaga |
| | | cgatgagctggaagagagacaaactgatcttcaccgagctgagcgcgccgagaaactggaagacagtggagaatgatgttcaggcctgctgattcaggacgcctg |
| | | agacatacgcgagaagctgagagtgccgcgcagaaacaaggcctaccggatcgacccgactcgagtggcagaaattcatcgtgaacacctcaagagagggcaacaagg |
| | | agcgccatcgtgaaaccagagagacgacccctgccaggggcatgaggggcatgagagtcgggcgaacagtggcctcaagaattcccagcaccatgacacactggaaa |
| | | gctccaagaagatgaccctgccaggggcatgagagtcgggcgaacagtggcctcaagaagatttcccagcaccatgacacactggaaa |
| | | tgctgaaccctatcatcgagacgtacagagctccaggcggcgaagctggcagtgcaaaaagatcggctggtgtgggggcaggaagcagcaggaagcagagatggcag |
| | | acactgacctcggtcagagcaacaatcacgtgtgcagtgggaccgacgatgtcatgctgcgaacctctagctctcaggtgtgccctgcctgctgtgacacggcatg |
| | | ttcaccagatcaccgacagatcacgagctgtgacgcgtctccagaagatcagactcaaggtgtcacgttgtgacgagactcagaag |
| | | ctgccaagcagctacagcgcgagtacaacatatcagcaggacgtacacggcgggcgagaactcggttcaccgagaactcggaacaatca |
| | | cgagcactcgaagagactcggcttctacgctcggcagcagcaacatcacaaggctggacagccacagagaagcaagacagcaggaagcgcgagaatcgatagagcctg |
| | | ataccgagttcctgagcggcttctacgctcggagcgcgcctatccggcagcaacaccaaggctggagccggaagaccagacagattcagagactggagggcggactgc |
| | | catctcgtctgtcgtcgctactacgtggacaactacaaccaggctggacgccggaccagaccagattcagagatggaggcggactgc |
| | | tgctctgccaagtgacaagggcgcagcggcctatccctgatgaggagacagacagaacgggacgcagcctctgcctagcttcgagaacat |
| | | catgtaccgggggcagattacctgccgccgctatcctgcatctcctctgatgggcaagacaacagagccagcgctgtcacatggagcgatcaat |
| | | gggcaagaaggtcttctgtccgccgcgtcatcctgatggcaacagagcaggactgcaatggctcgagagggatgagatgcaaatgggagcg |
| | | ggacagacccgagcaacagcctgtacaagcctatccgacgggacgcggtcacgcaacgagcagacaggctgcacagcagaccaacccaagcctgtgcacagaaag |
| | | gaacacagtccgactagcagcgctgcaggactgcatcaatcgagcagcagcagcagcccctgaaaactgcagaaaagcccaagcactcactgacgcagtaa |
| | | cccggacttcaactacgagcagctgcggcaggactacgacagtaa |
| T59-T2A- | FIG. 81 | aattctctgcagatatccagagcacagtggcgcccctcagtctagaggccctcgttaaaccgtgactcagctccgatctgattgcagccatcctgtgt |
| V8 (SEQ | | ttgccctcccccgtgcctcttcgaccctgaagttccactccctggaagtgtccactcccactgtcttctcctaataaaatgaggaaattgcatcgcatctgagtaggtgtcattctatt |
| ID | | ctggggggtgggggtggggcaggacagcaagggggaggattggaagacaatagcaggcatgctggggatgcggtgggctctatgggtcttggctctatggcttggcgg |
| NO: 924) | | agaaccagtcggggctcaggggtatcccacgctcagtctcctccttcctcttcccactcgccacgctcgcaagctgcaagctccgatcctcaaagctcggggctacacttgc |
| | | agtgcttacgcaccctgcaaaaacttgattaggttagagatagagtgttcaagtgcgatgagccatcgccaccctatctcgtcgcacccctaggtccgatt |
| | | cgtcttaatgtggactcttctccaaactgaacacaccaacctatcgcttcttgattatataaggatttcggcgattcggatttagtagaaaaa |
| | | tgagctgattaacaaaattaacgcaagtcgtgaattcgtgtgatgtcgcacagggtgaattcgcagagtcccagcagcaagcagagaagtccaacagtcc |
| | | atgcatttcaattagcagacaccgttgaaagtatgagaaagaactgcatttggtggatgcaatggctcaattagcagcaacaagtcc |
| | | gccctaactcctcccggccccttcagagccccgaaagtccgcagtgtgccgcgtgcacggtggctggacacggcgaccaggcggccccagacaatgaca |
| | | cctgagctaacttcatccgaagtcgtagaaatatgcctcccagagactcgacagatgcacagaatatgtgctggagacggtgacagcaaggca |
| | | gatgaggatcgtctatgatgaacaagattaacgagactcccgctgtcacagcgcccctgtccgtcaaagctgcgtcgtgccagatgaaaatggtgcgt |
| | | ccgtgtctgatgcgcccgctatctgctgctgtgccgctgggcgaccaggctgtgcagctgctgaggttacgcgaatctcctggaagtg |
| | | gacgccgcctagcggcttcagtgcgccatcgacgcctccaggctccagggttcgcgacctgccaggatctccgttcaccggctgctgcccgaatatcagacttgtccggggcgc |
| | | tgccccgtttcttggattcatcgaatcggcgaagagcgtgccaccccacaagcagtggctgcgccgcgtgccgctgctgccgcagagtgcgaagcgaagctgggcgg |
| | | aatggcgccgttcctcctcgtcttacggtgcttctgcgcctgctgtgccagatttcgatccaccatgcgggaaaccgtgcaacaaccgcgggacacaagtccgggacgc |
| | | tcgaaatgaccgaccaagcgaccgccaacctggctcgcgtgccagatcgagctgcggcgctaggcgccttctagtaaaagctggcttgctgctgctgctccggggacgc |
| | | gctggatgatcctccagcgggagatcttcacctcgatcatcaggagctctctaaagctggcgtaaagctacgctactgtggtgccatacgcagtcacaagcttatggtatacatacgccactg |
| | | catgtcatagtgctttctgtgaaactgtatctgccctgtcccaacacaacacaagcagctcacaactgcatcatgcagactaaaagcgcctcactatgagcctgctagtctgagtctgagatgagcggcggttag |
| | | ctaactacatttaatggctctgcctcactgcgcgcgttccagcgggaaccgccgcttcgctactacccggctcggctactaaagcagctgctcaagcggtattctcgg |
| | | ggtatgggctctcctcggctgctgatctgctgccaacctgctgttcggcgccgcgaatatccggccagttcactggtcaaaggccgtatgacgcaaacccggcgctaa |
| | | ccagataccaggggtaacggcggaaggacaatcttcgcagcaaaggccagaagcagtaaaaaggccgcgttgctggcgtttttccatagg |
| | | ctctcggccccccctgacgagcatcacaaaatcgacgctcaagtcagaggtggcgaaaccccgacaggactataaagataccaggcggttcccctggaagctc |
| | | cctcgtgcgctctcctgttccgaccctgccgcttaccggatacctgctcgcctttctcccttcgggaagcgtggcgctttctcatagctcacgctgtaggtatctcagt |
| | | tcggtgtaggtcgttcgctccaagctgggctgtgtgcacgaaccccccgttcagcccgaccgctgcgccttatccggtaactatcgtcttgagtccaaccccggta |
| | | agacacgacttatcgccactggcagcagccactggtaacaggattagcagagcgaggtatgtaggcggtgctacagagttcttgaagtggtggcctaactacg |
| | | gctacactagaagaacagtatttggtatctgcgctctgctgaagccagttaccttcggaaaaagagttggtagctcttgatccggcaaacaaaccaccgctggta |
| | | gcggtggttttttgtttgcaagcagcagattacgcgcagaaaaaaaggatctcaagaagatcctttgatcttttctacggggtctgacgctcagtggaacgaaaa |

TABLE 34-continued

| Constructs | Maps | Sequences |
|---|---|---| ctcacgttaaggatttggtcatgagattatcaaaagatcttcactagatccttttaaataatgaagttttaaatcaatctaagtatatgagtaaacttg
gtctgacagttacccaatgcttaatcagtgagctgcaattgaccacctatccagccgatcgtcattcattcgttcatccatagttgcctgactcccgtcgtgtagataactacgatacgg
gaggcttaccatctgcccagtgctgcaatgatacgcggagaccacgctcaatgtgttgcggaagctagaagaactaccattatcagcaatcagccagccagcggaaggccga
gcgcagaagtggcctgcaactttatccgcctcaatccatccagtctcattaattgttgccggaagctagaagaagttcgccagttatcgccaacgttgc
catgctacaggcatggcgtcacgctcggtgatgcctcattcagctcgcgagctagaagcaagagttccaacgtacaggagttcagtcggtgtgcaaa
aagcggttagctcttcggtcctccgatcgtgtcagaagtaagtggcgcagtgttatcactcatggttatgggaccagtgctcttgcccggcacactgcataatctcttactgtcatgccatc
cgtaagatgcttttctgacctggtgagtactcaaccaagtcattctgaagaacgttcggggtcaaaacttcaaggatcttcggccgctcaagtcagttcgatgtaacca
ggccacataggcagaacttaaaggtctcatcattggaaacgtctctcgggtgagcaaacaggagcaaatcgcaaaaaggaaaggcgaca
ctcgtgcaccaactgacctcgacgtcagttcaccaacgtctcggtgagcaaacaggagcaaatcgcaaaaaggaaaggcgaca
cggaaatgttgaataactcatctcctctttcaatattatgaagcatttatcaggttatgtccatgacggatacatattgaatgtattagaaaataacaaat
aggggttccgccacattcccgaaagtctgctcctcgctgtgtgtggagtcgctgagtagctgcgagcaaaattaagctacaaacaaggctacgacaatg
catgaagaaatctgctaggttaggcctgtcgtcgctgcgtcgcgtacgctgatcgcgtgactagcatggcatcaatcatatcaattacg
gggtcattagttcatagccatatgagtttccgcgttacataactacggtaaatggcccgctgaccgccaactgctgtaccgccaccattgactgtcaata
atgacgatgttcccaagtacgccaagtaacggactctccaatggcggactatttaccgtaaactgcccaatggagtacgtgagcaatgctgaatatcatgt
gcccagtacgcccatcattgacgcaatgacggcagtgacctggacacatgaccctatgggacttcctacttggcagtacatctacgtat
tagtcagctattaccagttgcgtggtgttgtggcagtacataccgggcgtgtgactcacgggatctcccaagtcctccatgacgtgtcaat
gggagttgttggcaccaaaatcaacggacttcaaatcgtgcgtcaactgtcgctgctctgtaacactcgcccccattgacgcaatgggcgttacggtagcgtgcgtacggtgagtctca
tataagcagagctcctggctaactagaaaccactgctctggcttactggcttatcgaatatataacgactcactataggggaagaccaagctggctagcgtctagcgtttaaactta
agcttgccaccATGaagctgctgatcaacctcagtgcagctgtggccaagactgtgggactcagagacaccctggggacctgatgccgcaagaaccacccc
ctctgataacaagctgctgcccaagtactggagaaaggcccagtgtttggacaaggcagaatctccccaagctgtgaaaacctggtc
aacagcttcaagaccaagagacagatcgaggcaagcaaagagttctacacctgtccaatgctcgtggtgactacgtgtcaagtcgttcgccctgca
gaagcggcggaagagacagatcgaggcaagcaaagagttctacacctgtccaatgctcgtggtgactacgtgtcaagtcgttcgccctgca
catcaggaccaaggccaacgagatcctgacacagttcaccctcagagcgacgagagcagaaccagcagaaccctgacccagatcctgacagatcgccagatgcgccatttgctcctaccgctgaagaacaactgc
cagatcagcgaggtggacgaggcagaggaattcaccaagaagcgcggaagaaagagattgagatcgcaggaagaatcagctgcagagcagg
atccctaaggcagagatctgacggccagagaagtgctcaattcctgtggcctacgaagcagggtgctgacacgtctggcgacaaggcgactattcaaggcgttctcgagacccagagatgtgaagcgg
caagccctctgctgagaaaagcgcaaggccgctgcatttcctggcgtgctacacgactactacagctgcagcgctcaggcgcttctcgagagcgggtgaagcgg
aacacaagaataccgacagcctcctcctcaccccgcggatggtggaccgccagatgtggccctgcgcgaggaaagtgaacca
gctgcacctgtactgcaccggtgacaccagaatggacacgcgaggaaccagcaggtcgtgacagacgcacactgacaatctgttcccagacctaa
aggccaagcagcagataccagggccgacctgccagcctcctatcctcgctcggcctgggcgtctcggcctggcctggtggacgtggtgaagatgagg
tgctggctcacagcctctgctgccaacgaatgtgaagaccacaatcgctgaagcagcagcagcagcagcaatcaatgtctccaggagaacaa
ggcccagaagaagcagaagaacgccctaacagttggctggcgtgagatatgagagacagatcagcagcagagatcagcagagatcgctgcggcattgccccggctacaa
ccaggccggctccatccgctgctgcccaagctggctgccagagatgaaggatcagagcagatgtggcctcaccggtggctcctgtgagtgcacagctgcccggcccaagc
agaggtagcgtttgttcaactgcactacggcccaaagaataccggatgagcggtcaccggtggtcctacggccgtatgatcaaggagccaaggc
cgaattctctacagagtcggaccggccctatccggcctacgccagcactacgccaggcacatccggccaggcactcgaccagaaaggcgctct
gatcAGCCGGCCTCTCCTACTTCTACAGAGAAGGTTCTCTCGCTGCAGTCCCGGACCTCAGAGTGCCCCACCACCCCGAAAGTGACCTGGATCTC
CTGCCGCGCTCTCCTACTTCTACAGAGAAGGTTCTCTCGCTGCAGCCCGAAAGTGACCTGGATCTC
ggaagccggcgtgagtaaggtgaagaactcttcactggagtagtgccattcggtgagatctgatggagatgtaaatgacataaattctccgtcagggcga
agccgaaggggacgccacgaatgtaacctgaaattcatctgaaatcgtgagctgcccatgggctacactcgtaacgaccctcacctac
ggcgtgcaatgcttttctccgatatccgaccacatgaacacagctgacttttcaagctgcaatgcgtgaaatcgtgttaatgcaagctgtgttcaagaaggacatcagcttaagga
tatggtacatataaaaaccggcgaggttaaatttgaaggaacactctgttaatcaagcagaaaatgggtaatcgcgacataatgtcgaa
ggcacaagttggagtacaacttaacgctgtatattaccgctgataaggtgcctgacccaacttaaggatccgacataagtccgaa
gatgttagtgttcaactggctcaacttaacaagaataccggtgcctctgaattgtgactccgcagccattgcactccacgcatcaaagctttc
caaggaccaacagaagagagatcactgggtctacgcgggatattgtccgcgtgatcacctcggcatggagtgactgtgactgagcgctcc
GAGGCAGCCTGCTTACATGTGCGACCTGCGACTGAAGAACCCCGGACCTaaggacgactactgcagagatggt
gcagaacctgtgggcgacgaccccattcctgaagactgcagccagatcgagaccgagactgtggagccctttgctgtggaactgaacatccagaaga
agcgaaggggacgctgaacaatgtaagctgtcaagcagtgcgcagcgggcagaattgtggccctccagagccccgaagagcgtgactgttacggcgtgc
tcaacagccccagaaaggccagcgggcagatgtgccccgtgtattgtgcccgtgatattgtcgccgcgtgctcctagcaggtgccgattgctcagggcgaaggctgtgctgtgatcct TABLE 34-continued

| Constructs | Maps | Sequences |
|---|---|---|
| | | ggaaagcctgaagtacgatgccaccagcgcaagctgaccgctgagaagaagtgcagcgcctgctgaagaagcaagtggaaatgctgattatc<br>gacgaggccaacttcctcaagctgaacaccttcagcgagctgagatcgccgagtgctacgacctgtctgagaatcagcatcgtctgtgggcaccgacggcctggac<br>aacctgattaagagagagccctacatccacgaccggttcatcgagtgctacaagcgccctggtgaagcgagaagaaattcaccgagtggtcaagatct<br>gggaagagaggctgctctgcctgcctgccagcaactgaccagaaggcgctgaaccctgccgaacactgacaaagaccggcggaaagatcggactggt<br>ggacagagtgctgcagagagccctctattctggcctgagagcctgagaaagatgacaagaaatatcgacaagaaacctgacctgcggaagtgctgagtgtcgagtgaga<br>tatcgaattggatccgcccctccccccccccgaaactgggccctgtcttcttgacgagcattcctagggtgctttcccctcgccaaaggatgcaaggtctgttgaa<br>ttgccgtctttggcaatgtgagggccgggaagcagtcctctggaagtctgaagacaacaacgtctgtagcgacctctgtgaggcagcggaacccaacctggcgacaggtgcctc<br>tgcggccaaaagccacgtgtataagatacacccgcaaaggcgcaccacccagtgccacgtgcccacgtgatagtgtggaaagagtcaaatggctctcct<br>caagcgtattcaacaagggctgaaggatgccaagaagtgccccattgtatggatctgatctggggcctcgtactaaacatgttacatgtcttagtcgaggtt<br>aaaaaaacgtctaggccccgaaatcggagccgaggaaccccacatctcgaggtggaacctcgaagcctgtcccactcctggcagattcagaaga<br>gagaactacctgaccagcagccagcggctggacaggactggtgtgtcccggtgaagaagctgtactcaaccattcaacgcgca<br>agagctgaagccctgacctctgtcgtcagagtgaacgccgatagacctggcccagatgctgcctccaagggtgaccatgaacctgacctatcagact<br>gtgcgccgcctgttatccgagtgccctgtcacagaatcgagtggcagtcaaggacgtgcccacgtgtatgaatgcggaccgcacaacctgagactgctgaccaagtg<br>caccaatgcggacaagcttccccatcctgccgaatgggtgcaggtgcgagtgcccttctgcctttgccacatggccaagcggcagaaacac<br>ggcGAAGGCAGAGCAGCCTGCTTACATGTGGCCAAGAACCCCGACCTccaaagagaa<br>gcggaagtgcggtggcggaagcggcgagatgcccatcgtgaagcagcgacgagtgccctgtgaaaacaacgacgatgtggatgagatcca<br>ggacgatgagctggaagaagacaaacgtgatcttcaccgagctgagccgagcccaagctgaagatgagtgattcaggcctgtgtgaacctgcgaca<br>gaaagacatacggcgagaagcgagaagtggccgccagaaactggaaagacagtgcgcaggtgcgcggttgtcaagagtatcagcaggacggc<br>ctgagcgccatcgtgaaaccaagagacgacaaggcagtcccgaggtgccatgtggcagtgcagagagccagtgagagtgagagccagtgcagtcgggctgaacagtgcaggtgctgaacaaattcatcgtgaacacctcaaagagggcaaca<br>agggctccaagaagatgaccccctgctcagtggcccatggagatcggggctggcccgcagagagagagaagcagaggtgcagagaagtccagagctgtgctgacccatgaccgtacc<br>ggtgctgaaccccatcatcgagcgtgcagctacatccagtgtggcagaatcaccaagctggatgtcatgtggcagtcagagcggccttgccagacc<br>cagacatggacgtgcgtacagcaatccacggtgccggacgtgcaatcaccaagctggaccatcattggcccacgtgcttatgcctcagcctcagggtgctgggcctgcctttgcaggtgaccagtacggcgagcctcttgcagcc<br>atggttcaccagatcgccacccagctacagcggtatgccagcacgagtgcaagcaaggttcaaacgtgaaaatcgtactactgcagcggcagagacttca<br>ccattctgcctagcagcacagcgccagtacaaaactgatcagcgacgggcacctgaccttcactgtacctacgaggcaggaagactca<br>gaagcgcacctgaagcctgagacagatcggcttccagtgcttcaactggaccagacagaccctcgagtgaaggcggcatcgaagaggcgcatcgaagtcgaac<br>atcaatacccgagttcctgagccgctctacggcgctcatgtggcagctggacaataccacagaggctggaccgccaaggaccagacagatttcagagtggaggccgga<br>ctgcctgctctgccccagatgtgaaagcggcgagtggagctggcagatgatgaaacccggcatcaaaggcggcatctagcttcgag<br>aacatcatgtaccgggcgattacctggcccgctatgccgcgcagaatatcgctgaatacagagacagtgtccctgaagaagcaagccgcctcctagaaaagtgcg<br>gatcaaggcaaagaggtgtcctgcccgctcatgccttggcaagctctatcctggccagacagatagcccggaccagaggcggcgccctggtgtaccaaagtgcg<br>gagcgtgggcaagacccctgagacaacaagtctatcctggcggacaagtctacccacgcaggaggcacctttacccaagacgaagaagagagccaag<br>aagagaaacgggcggccagactgtcaagagcctgagcctactcaattctagcagacaagccctgaaaactgcgaagaacccgtacca<br>gaaagcccggatcttcaactacgagcagctgcggcaggactacgacgagtaa |

Applicants also tested fusion of dCas9 and Cas12k. In these experiments, dCas9 was fused to either the N or C terminus of T59 Cas12K. The RuvC dCas9 Fusions were similarly designed, except the inactivated RuvC domain of Cas12K is removed from the construct. Sequences and maps of the constructs used in the experiment are shown below.

TABLE 35

Figure 82:
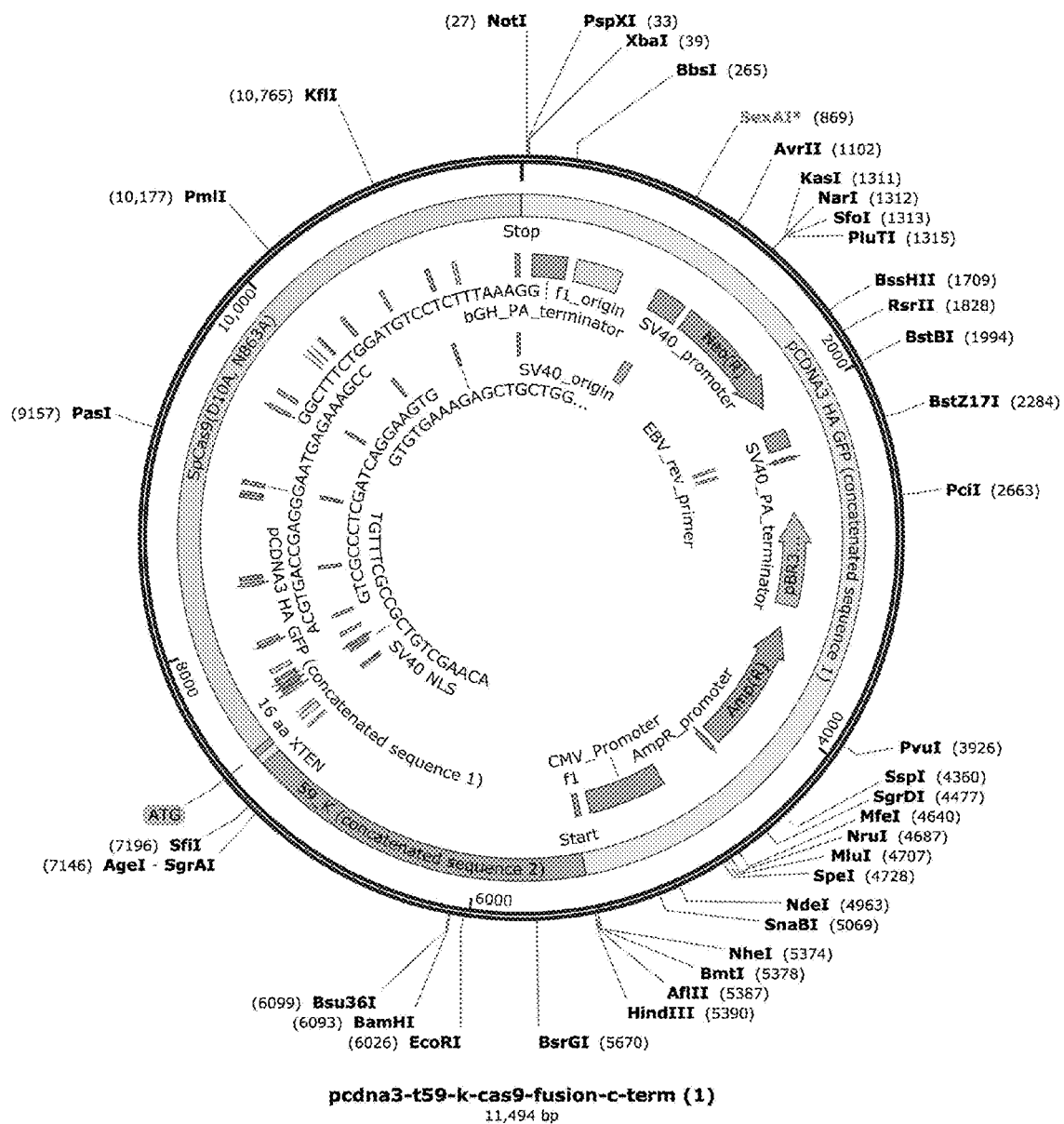

| Constructs | Maps | Sequences |
|---|---|---|
| pcdna3-t59-kcas9-fusion-c-term (SEQ ID NO: 925) | FIG. 82 | aattctcagatatccagcacagtggcggcgctcgagtctagagggcctcgagtcgatcagccagccgctgactgtgccttctagttgccagccatctgttgtt<br>gccctccccgctgcctcctgacctgaaggtgccactccactgggattgtacaacaaatggaaatgatcgcatgtctgagtcagtttgcattctatctctg<br>ggggtgggtgggcaggacagtgggctaggggggtgggatggaagcagcatcggtgggatgggtgggctctatgccttctgaggcggaagaa<br>ccagctgggctctagggggtatcccccagcgccctgcccacctcaagcggcggggttcccctgaagtctccaaatcgggagctcccttaggttccgattagtgcttt<br>acggcacctcgaccctagaacaaactcgattaggtgatggtcacgtagtggccatcgccatcctcttgattatcaaggcggttcgcgtttgcgattgagtccaactgttttaa<br>tagtgggactcttgtccaaactggaacaacactccaacctatctcggctattctttgatttaagggatttggcgattcggctatggtaaaaatgagctgatt<br>aacaaaatttaacgcgaattaatctcgaattgtcccagtagtgcaagaagtatgcaaacatgcatctcaatagtcagcaacatgtcaagctcatccaatt<br>agtcagcaaccagtgtggaaagtcccccagcagcagagtatcaaatatgctgactaattttttatttgcaaggcgcaggcgcctgcctgacctattcc<br>ccaatccgccctaatccgcccagtccgcacgtcccagtccgcaaaaggccccagtcttttgcaaagaaacagagcccgagcgctgatctggcacctgagaggacggagatcgttc<br>agaagtagtgaagaaggcttttttgaagcctcaagcctttccggccccttcccggcgtcttgatgcagtgtcactgaactacgccagaaggtgactcagggtctaagaggcgtatcgtgg<br>gcatgattgaacaagacacaggttctgatgcagacgcccgccgcaggttcctcccgcgctgcttcctcgtgtgcctgccgaataactggactggcatacgcgtgctctgatccgg<br>ccgtgtccggctgcccagaccggttccttgcgcaggtggccccggtccttgcagaaagatcagagcgagaggccattgccgatggcacctgcagccgaaagttcggcacgg<br>gatctcacctgtcctgccagaaagtatccatggtcaatcaggtctgtcgatcaggatgcatcaggagctgccggcatacgtcctgcccccatcgaccaccagcgaactgtggcatcatcgact<br>gtggccgctggtgtgtgaccgcgtatcaggacatagcgttggctacgccttctatgccgggaatgctttcggaacgctggcgagatatccgcaggcgtatctagtcacgacagcccagc<br>ggtatgcgctcgccgcggattcgcgccagcatcgccgtctatgagcctcctttgacgacgtgtcctgagcgggactcgggtcgaatgacgaccagcgaccgcc<br>aactgtccatctcgcgccccccactgtttattgcacgtacaaagattgacaatcagctcgacttcaaaaagcatcatacaacttttcactgcaatttcctcgattcaatctct<br>tcatgctggagtcttcgccacccaacctgtttattgcacgtacaaagattgttacgacgtcgacctctgacactcagctagatagcgctgccattgagactgcatcgcctctgagcgat<br>agtgtgttgttccaaactcatcatcaatgtctcagtatctctatgaggtgcctatgctgcgtaatcatgtgcgctagagcgtgcgtaatcatgtgcatagcgtctgtgtgttcgctgtgtgaattgtta<br>tcgctcacaattccacacaacatacgagccggaagcataagctcgcagcttgactacataacactcagcagggtgcctaatgagtgagctaactcacattaattgcgttgcgctcactg<br>gcttccagtcgggaaacctgtcgtgccagctgcattaatgaatcggccaacgcgcgggagaggcggtttgcgtattgggcgctcttccgctctctcgctcactg<br>actcgctgcgctcggtcgttcggctgcggcgagcgtcagctcactcaaaagcgcgatacggttatccacagaatcaggggataacgcaggaaagaacat<br>gtgagcaaaaggccagcaaaaggccaggaaccgtaaaaagcccgcgttgctggcgttttcccataggctccgccccctgacgagcatcacaaaaatcgacg<br>tcaagtcagaggtggcgaaaccgacaggactataaagataccaggcgtttccccctggaagctccctcgtgcgctctcctgttccgaccctgccgcttaccgga<br>tacctgtccgccttctccttccgggaagcgtggcgctttctcatagctcacgctgtaggtatctcagttcggtgtaggtcgttcgctccaagctgggctgtgcacg<br>aaccccccgttcagcccgaccgctgcgccttatccggtaactatcgtcttgagtccaacccggtaagacacgacttatcgccactggcagcagccactggtaaca<br>ggattagcagagcgaggtatgtaggcggtgctacagagttcttgaagtggtggcctaactacggctacactagaagaacagtatttggtatctgcgctctgctgaa<br>gccagttaccttcggaaaaagagttggtagctcttgatccggcaaacaaaccaccgctggtagcggtggtttttttgtttgcaagcagcagattacgcgcagaaaa<br>aaaggatctcaagaagatcctttgatcttttctacgggggtctgacgctcagtggaacgaaaactcacgttaagggattttggtcatgagattatcaaaaggatctca<br>cctagatccttttaaattaaaaatgaagttttaaatcaatctaaagtatatatgagtaaacttggtctgacagttaccaatgcttaatcagtgaggcacctatctcagcgat<br>ctgtctatttcgttcatccatagttgcctgactccccgtcgtgtagataactacgatacgggagggcttaccatctggccccagtgctgcaatgataccgcgagacccac<br>gctcaccggctccagatttatcagcaataaaccagccagccggaagggccgagcgcagaagtggtcctgcaactttatccgcctccatccagtctattaattgt<br>tgccgggaagctagagtaagtagttcgccagttaatagtttgcgcaacgttgttgccattgctacaggcatcgtggtgtcacgctcgtcgtttggtatggcttcatt<br>cagctccggttcccaacgatcaaggcgagttacatgatcccccatgttgtgcaaaaaagcggttagctccttcggtcctccgatcgttgtcagaagtaagttggccgca<br>gtgttatcactcatggttatggcagcactgcataattctcttactgtcatgccatccgtaagatgcttttctgtgactggtgagtactcaaccaagtcattctgagaatagt<br>gtatgcggcgaccgagttgctcttgcccggcgtcaatacgggataataccgcgccacatagcagaactttaaaagtgctcatcattggaaaacgttcttcggggcg<br>aaaactctcaaggatcttaccgctgttgagatccagttcgatgtaacccactcgtgcacccaactgatcttcagcatcttttactttcaccagcgtttctgggtgagcaa<br>aaacaggaaggcaaaatgccgcaaaaaagggaataagggcgacacggaaatgttgaatactcatactcttcctttttcaatattattgaagcatttatcagggttatt<br>gtctcatgagcggatacatatttgaatgtatttagaaaaataaacaaataggggttccgcgcacatttccccgaaaagtgccacctgacgtc<br>taagaaaccattattatcatgacattaacctataaaaataggcgtatcacgaggccctttcgtc |

TABLE 35-continued

| Constructs | Maps | Sequences |
|---|---|---|
| | | aatgggcggtaggcgtgtacggtggaggtctataagcagagctctctggctaactagagaaccactgcttactggcttatcgaaattaatacgactcactat |
| | | agggagaccaagctggctagcgtttaaacttaagcttgccaccATGagcgtgatcaccaccagtgcagactgcagaggcacatcctgagacag |
| | | ctgtgggagctgatggccgacaagaacacccctgtcaacagcttcaagctgctgtccgaccagctcgcgaccagctgtgcagatctctacacctgcttggttgac |
| | | atccccaccaagtgctgaaaaccctgtcaacagtgctgcaacagttcgccaagagaattcgccgaccagctgcgaccagctctacacctctgctctggtggac |
| | | tacgtgtacaaagattggttcgccctgcagaagcggcgaaagaacaatgcgagggcaagagatcgctgacatccctgaagtccgacctgcagctggaa |
| | | caagagtcccagtgtacgcctgagcctgagcgccatcagagaccagctcagagcgccaagagtcaccctcgacacagtctgaacacagcagcgaaggg |
| | | cctacctgctgaagaacaactgccagatcagcagtcggaagtgacagcagcgaggatcggacgaggaattcaccaagaacggccagaatccctgacagatgcgccattg |
| | | aagaatcagctgcgaagcaggatccctcaaggcgaagcagggtgacggcagagagatctgagaaaaagcggaaggaatgtcaccaccgcccaaccagctgcccagaacga |
| | | gaatgaagccaagcctggcaagccgctctgctgagaaaaagcgccgacgtgccattctctggtccacgaggcaacagagacattgacctggctgcagaa |
| | | cgacaaaggcagactgtcgtgcgtgcaaccacagctacagacagctccctgctcacctggagtggtagactgcttggagccctggcagtgaaaaggcgagcc |
| | | ctgaaattgaaccggcggaaccacaaagtcagtactacgacgtgcagcaccagcagccagatgcgtggacagcagaaaagcaccaagatcaa |
| | | cgaaaccctgacaaagccaagcagacagcagagacagaccttgaaccgacaagacccagcagcaccatgctgacgtgaccgtatccaccatgctgacgtgaccgatcaacaatctgt |
| | | tcccagaacctagcaaggacagataccaaggcagctcctctccgtggcgtgccctcggctggaactacaactgctgaaccggacagcagcagactgtctcacga |
| | | aagaatgaggtgctggcctacgaaggctgaaacagtgtgaaaccaccgagccgtgaaaccaaccagagagccagcatgccatccatgccgtgacacccatcctgtgaacgtgtcccacga |
| | | gagaacaaggccaggcaggataacgcccctaacagctggggtgccaggtgaagagcagagaggcgcgatccatcttgccattgcc |
| | | aagcataccaggccggcctcatcgtgtcgccccaagagaataccggcaagagtaccggatgagcgtgtcaccggttcatcaccgcagcagaagtgcccg |
| | | gtcaagaggtgcagcagaagtgcacagagtcggcaccagaagtaccggatacccggtgagctgccgtgagtccgacagctggtcatcaagagccaggccgcc |
| | | aagccggaatcctacagagatcggcaccagctggctgctgcctccctcaaggaaggccagatgtggccgtgtcctaccaagagcaggcc |
| | | gtctgatcAGCCGCAGCGAGACTTCCCGGACCTCAGAGTCTCCCACACCCGAAAGTcaaagaagaagcggaa |
| | | ggtcggtgcggaagcggcGACAAGAAGTACACAGCATCGGCCTGCCATCGGCCCACCCTGTGGGCTGGG |
| | | CCGTGATCACCGACCGAGTACAAGGTGCCCAGCAGAAGAACCTGATCGGAGCCCTTGCTGTTCGACGGCGCGAAACAGCCGAGGC |
| | | ACCCGGCTGAAGAGAACCCAGAGAGAATCAGCCAGAGAGATCTGAAGCGAAGAACCTGATCTGCTATCTGC |
| | | AAGAGATCTTCAGCAACAGCAGATGGCCAAGGTGACAGCAGACGGCACCCCATCTTCTTCCACAGACTGGAAGAGTC |
| | | CTTCCTGTGGAAGAGATAAGAACTACCCCACCATTCTGCCACTTGAGAAAGAAACTGTTGGACAGCACCG |
| | | GTGCCCTACCACCAAGATCTGCGGCTTGATCTATCTGCCTGATCTGAGAAGATCAAGTTCCGGGCCACTTC |
| | | ACAAGGCCCAGCTTGCCGGACCTGAACCCCGACCACCAGGACTGCAGAAACAGCTGTTGGACCAGCACCG |
| | | CTGATCGAGGGCCGCCTGAACCCCGAACACAGCAGCAGCAGCAGCGTGGACAAGCTGTTCATCAGCTGGTCA |
| | | GACCTACAACCAGCTGTTCAAGGAAGACAGATTTTCTTCGACAGAGCAAAGACGCTACGCCGGCTA |
| | | CTGTCTGCCCAGACTGAGCCAAGGCAGCAGATTTGATCGCCCAGCTGCCCGGCAGACAGCAGCAGAGATG |
| | | AGAAGAATGCGCCTGTTCCGCCAACCTGATTGCCCTGAGCCTGGCCCTGACCCCCAACTTCAAGAGC |
| | | AACTTCGACCTGGCCGAGGATCGCCAAGCTGACCTGAGCAACGACCAGCTACGACGACCACCTGG |
| | | ACAACCTGCTGGCCCAGATCGGCGACCAGTACGCCGTCAGTGAACACCGAGATCACCAAGGCCTGTTTCGCAAGAACCTGTCC |
| | | GACGCCATCCTGCTGCTGAGCGACATCCTGAGAGTGAACACCGAGATCACCAAGGCCCCCCTGAGCGC |
| | | CTCTATGATCAAGAGATACGACGACAGCAGCAGGAACCCACCAGGCTGTCGACCAGGTCTGCCCTGTCTGTGCGGC |
| | | AGCAGCTGCCCTGAGAAGTACAAGAGAGATTTTCTTGCCACAGCAAGAACGCTACGCCGGCTA |
| | | CATTGACCGCGAGGAAGTGCCAGCCAGGAGTTCTACAAGTTCATCAAGCCCATCCTGGAAAAGATG |
| | | GACGGCACCGAGGAACTGCTCGTGAAGCTGAACAGAGAGGACCTGCTGCGAAGCAGCCAGACCTTCGCGGCGAG |
| | | TCGACAACGGCAGCATCCCCCCACAGATCCACAGATTCAACAGCACTGGGAGCAGCTGCAGCCTTCTGCGCAGCAG |
| | | GAAGATTTTTACCCATTCCTGAAGGATAACAGAGAGAAAAGATCTGACAAGATCCTGACCTTCCGCAT |
| | | CCCCTACTACGTGGGCCCTCTGGCCAGGGGAAACAGCAGATTCGCCTGATGACAGAAGACG |
| | | GAGGAAACCATCACCCCCTGGACTTCGAGGAGTTCGAGGAGGAAGGTCGCGCCTTCCCCCCAGAGCT |
| | | TCATCGAGCGGATGACCAACTTCGATAAGAACCTGCCCCAAGGAGAGAACTCCTGCCCAAGCAGGAAGG |
| | | CCTGCTGTACGACTTCACCGTGTATAACGAGCTGACCAAAGTGAAATACGTGACCGAGGGAA |
| | | TGAGAAAGCCGCCTTCTTCTTCCGGCCTGAAGAAGATGGACATCCACGCCTGAATGCCATTGTGGCAGAGACAACATGCCGAA |
| | | CAACCGAAAGTGACCGTAGGCGCGAGGTCAAGAGGACTACTTCAAGAAATCGAGTGCTTCGAC |
| | | TCCGTGGAAAACTCCGGCGTGGAAGAGTCAACAAGCAGGCCGTTCAACCGCCATCTGGGCACATACCAGATCTGCT |
| | | GAAAATTATCAAGGACAGCACTTCCTGGACAATGAGGAAAATGAGGAAATCGAGGTTCATTCTGAAGATATC |
| | | GTGCTGACCCTGACACTGTTTGAGGACAGAGAGATGGATCGAGGAAGACGGCGTGAAAAACGGCTGAAAACCTATGCCC |

TABLE 35-continued

Figure 83:
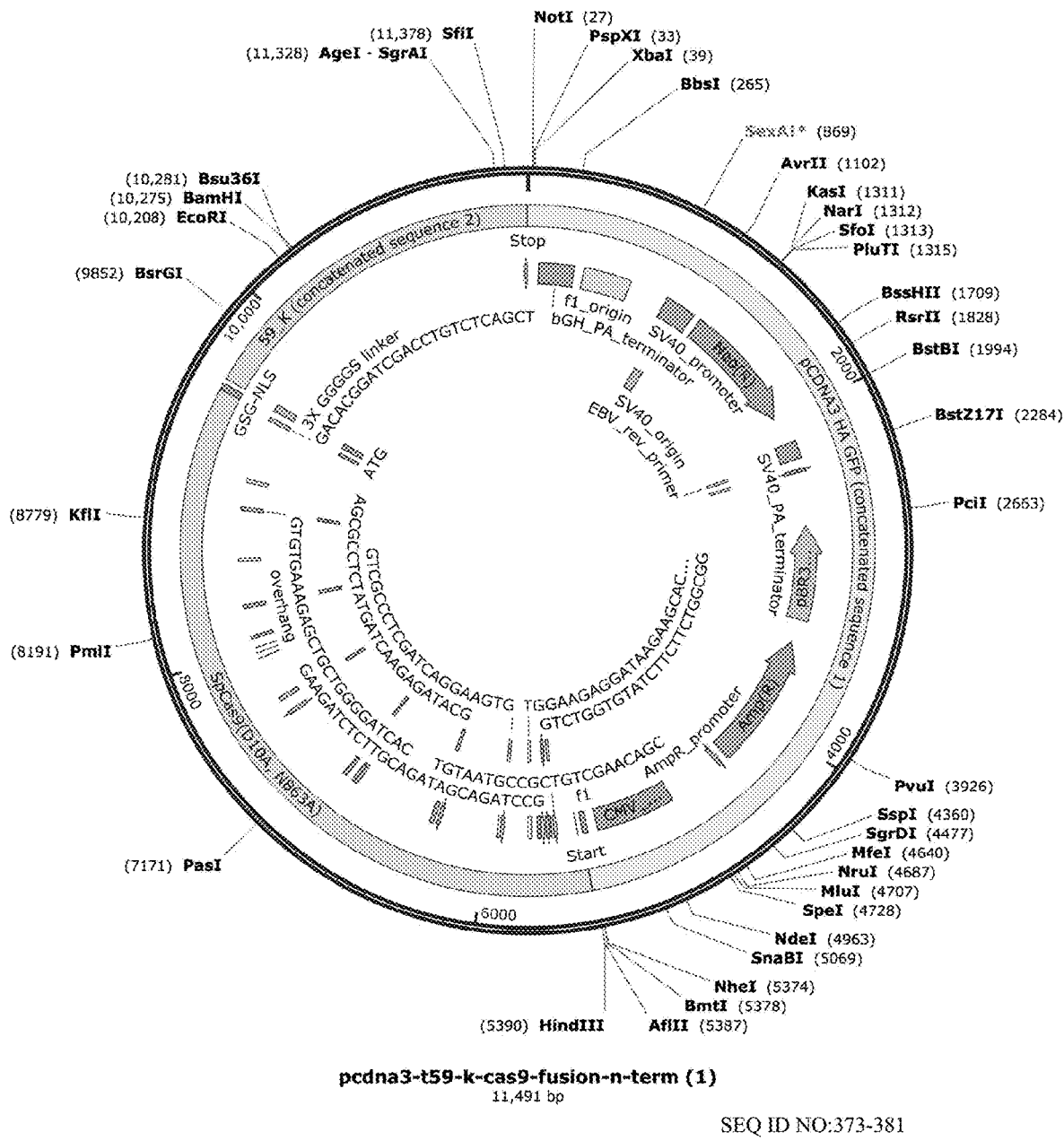

| Constructs | Maps | Sequences |
|---|---|---|
| | | ACCTGTTCGACGACAAAGTGATGAAGCAGCTGAAGCGGCGGAGATACACCGGCTGGGGCAGGCT |
| | | GAGCCGAAGCTGATCAACGGCATCCGGGACAAGCAGTCCGGCAAGACAATCCTGGATTTCCTG |
| | | AAGTCCGACGGCTTCGCCAACAGAAACTTCATGCAGCTGATCCACGACGACAGCCTGACCTTTAA |
| | | AGAGGACATCCAGAAAGCCCAGGTGTCCGGCCAGGGCGATAGCCTGCACGAGCACATTGCCAAT |
| | | CTGGCCGGCAGCCCCGCCATTAAGAAGGGCATCCTGCAGACAGTGAAGGTGGTGACGAGCTG |
| | | TGAAAGTGATGGCCGGCACAAGCCCGAGAACATCGTGATCGAAATGGCCAGAGAGAACCAGAC |
| | | CACCCAGAAGGGACAGAAGAACAGCCGCGAGAGAATGAAGCGGATCGAAGAGGGCATCAAAGA |
| | | GCTGGGCAGCCAGATCCTGAAAGAACACCCCGTGGAAAACACCCAGCTGCAGAACGAGAAGCTG |
| | | TACCTGTATTACCTGCAGAATGGGCGGATATCTACGTGACCAGGAGATGGACATCAACCGCT |
| | | GTCCGACTACGATGTGGACCACATCGTGCCTCAGAGCTTTCTGAAGGACGACTCCATCGACAACA |
| | | AGTGTCTGACCAGAAGCGACAAGGCCGGGCAGCTGCTGAACGCCAAGCTGATTACCCAGAGAAGTC |
| | | GAAGAAGATGAAGAATCTACTGGCGGCACAAGCTGGAACGCGAACTGATTAACGGCATTACCCACCA |
| | | GACAATCTGACCAAGGCCGTACCTGAGGCGGCCCTGATCAAGAGTACCCTAAGCTGG |
| | | GACAGCTGGTGGAAACCCGACACTCCAAGACACGTGCACAGATCCTGGACTCCCGATGAA |
| | | CACTAAGTACGACGAGAATGACAAGCTGATCGGGAAGTGAAAGTGATCACCCTGAAGTCCAAG |
| | | CTGGTGTCCGATTTCCGAGGGATTTCAGTTTTACAAAGTGCGAGATCAACAACTACCACCA |
| | | CGCCCACGACGCCTACCTGAACGCTGTCGTGGGAACCCTGATCAAAAGTACCCTAAGCTGG |
| | | AAACCGAGTTCGTGTACGGCGACTACAAGGTGTACGACGTGCGCAAGATGATCGCCAAGAGCGA |
| | | GCAGGAAATCGGCAAGGCTACCGCCAAGTACTTCTTCTACAGCAACATCATGAACTTTTTCAAGA |
| | | CCGAGATTACCCTGGCCAACGCCGATATCCGGAAGCGCCTGTGATCGAGCAAACGGCGAAAC |
| | | CGGGGAGATCGTGTGGGATAAGGGCCGGGATTTTGCCACCGTGCGCAAAGTGCTGAGCATGCCT |
| | | CAAGTGAATATCGTGAAAAGACCGAGTGCAGACAGGCGCTTCAGCGAAGAGTCTATCCTGC |
| | | CCAAGAGAAACAGCGATAAGCTGATCGCCAGAAAGAAGGACTGGGACCCTAAGAAGTACGGCG |
| | | GCTTCGACAGCCCCACCGTGGCCTATTCTGTGCTGGTGGTGGCCAAAGTGGAAAAAGGCAAGTCC |
| | | AAGAAACTGAAGAGTGTCAAGAGCTGCTGGGATAACGGCCGGATTTGCTACCGTGCTGAGGTTCGAGA |
| | | AGAATCCCATCGACTTTCTGGAAGCCAAGGGCTACAAAGGGCTACAAAGAAGTGAAAAAGGACCTGATCATCAA |
| | | GCTGCCTAAGTACTCCCTGTTCGAGCTGGAAAACGGCCGGAAAATGTCGCCCTCTGTACCTGGCCAGC |
| | | AACTGCAGAAGGGAAACGAACTGGCCCTGCCCTCCAAATATGTGAACTTCCTGTACCTGGCCAGC |
| | | CACTATGAGAAGTCGAAGGCTCCCCAGACAGATCAGCAGATCATGAAACACCTGTTTGTGGAACGC |
| | | ACAAGCACTACCTGACAGAAGTGCTGTCCGCTACAAGCACCGGGATAAGCCCATCAGAGAGC |
| | | GACGCCTAATCTGACAAAGTCTGTCCGCCTACAAGCACCAATCTGGAGCCCTGCGCCTTCAAGTACT |
| | | AGGCCGAGAATATCATCCACCTGTTTACCCTGACCAATCTGGGAGGTACACCCAAAGAGTGCGACGCCACCTGA |
| | | TTGACACCACCATCGACCGGAAGAGGTACACCAGCACCAAAGAGGTGCTGGACGCCACCCTGA |
| | | CCACCAGAGACTCACCGGCCTATGACGACACAGGCGATCGACCCTCTCAGCTGGGCAGGCGACTAA |
| pcdna3-<br>t59-<br>kcas9-<br>fusion-n-<br>term<br>(SEQ ID<br>NO: 926) | FIG. 83 | aattctgcagatatccagcacgtgggcgcctcgagtctagagggcccgtttaaacccgctgatcagcccgactgtgccttcagttgccagcatctgttgtt<br>gccctcccccgtgccttccttgacctggaaggtgccactcccactgtcctttcctaaataaatgaggaaattgcatcgcattgtctgagtaggtgtcattctattctg<br>gggggtgggggtggggcaggacaagggagaacatcagcaggcagggcggtgggctctcatgcttctgaggcggaaaga<br>ccagctggggctccagggggtatccccacgcgccctaggcggcattaaagcggcgcttctcccgcaagttcgcccgcttcccttaaggtccgattagtgcttt<br>cccctaggcgcccgccctcccttcgttttcccttcctcgcccgttcgccccgcttcgccttcagtttcgcctcccttaggtccgattagtgcttt<br>acggcacccgacccgaaacaactcaaccttacgcatttaggtgatggtcacgtagtgggcatcgtcacgtaggtctttataaggattataaggattttgtttaaaaatgagctgattt<br>aacaaaattaacgaattaattctggaatgtgtgtcagttagggtgtggaaagtccccaggctccccagcaggcagaagtatgcaacatgtcgcatccccaattcttg<br>aggcaaccaggtgtggaaagtccccagtctccggcccaccctccccccaaatgctgactaatttttttttatttatgcagaggccgaggccgccctgcctctgagctattcc<br>agaagtagtgaggaggcttttttggaggcctaggcttcctgcaaaaagctcccggagcttgtatactccatttttggattccttgatatccatttggggatctgatccc<br>gcatgattgaacaagatgatttgcacgggtcaagctagtcctagcgcccgccccaacatatttacagcatatgcaacacagacaattggcaatatggatcgttc<br>ccgtgttccggctgtcgcagggcgccagggccgcaggtctcttttgtcaagaccgacctcgccgttcgcgtgcctgaatgaactgcaagacgaggcagcgcggctatcgtgg<br>ctggccacgacgggcgttcctttgccgagaagtatccatcatggctgatgcaatgcggcggctgcatacgcttgatccggctacctgcccattcgaccaccaagcgaaacat<br>atctcaccttgctctgccgagaaagtatccatcatggctgatgcaatgcggcggctgcatacgcttgatccggctacctgcccattcgaccaccaagcgaaacat<br>cgcatcgagcgagcacgtactcggatggaagccggtcttgtcgatcaggatgatctggacgaagagcatcaggggctcgcgccagccgaactgttcgccagg |

TABLE 35-continued

| Constructs | Maps | Sequences |
|---|---|---|
| | | ctcaaggcgcgcatgccgacggcgagatctcgtcgtgaccatggcgatgcctgctgccgaatatcatgtggaaatgcgcgctttctcgattcatcgact
gtggccggctggtggtgccgaccgctatcaggacatagcgttggctaccctggcctcttgacgagttcttgacgggctctggggttcgaaatgacgaccgacgccc
acggtatcgccgctccgcgattcgcagcgcatcgcctctatcgcccttcatgaaaagttggcttcggaagcgtgttcggatcgatcctccagcgcgggatc
aacctgccatcacgagattcgattccacgcgcctgatttcatgaaagttggcttcggaagcgtgttcggatcgatcctccagcgcgggatc
tcatgctggagtcttcgccaccccaactgttattgcagctatatgttacaaataaagcacacaaattcacaaataaagcattttcactgcattct
agtgtggttgtccaaactcatcaatgtatcttatcatgtctgtataccgtcgacctctagagctggcgtaatcatggtcatagctgtttcctgtgaaattgtta
tccgctcacaattccacacaacatacgagccgaagcataaagtgtaaagcctggggtgcctaatgagtgagctaactcacattaattgcgttgcgctcactg
gctctcagtcgggaaacctgtcgtgccagctgcattaatgaatcggccaacgcgcggggagaggcggtttgcgtattgggcgctcttccgcttcctcgctcactg
actcgctgcgctcggtcgttcggctgcggcgagcggtatcagctcactcaaaggcggtaatacggttatccacagaatcaggggataacgcaggaaagaacat
gtgagcaaaaggccagcaaaaggccaggaaccgtaaaaaggccgcgttgctgcgttttccccataggctccgcccccctgacgagcatcacaaaatcgacg
tcaagtcagaggtggcgaaacccgacaggactataaagataccaggcgtttccccctggaagctccctcgtgcgctctcctgtccgaccctgccgcttaccgga
tacctgtccgcctttctcccttcgggaagcgtggcgctttctcatagctcacgctgtaggtatctcagttcggtgtaggtcgttcgctccaagctgggctgtgtgcacg
aaccccccgttcagcccgaccgctgcgccttatccggtaactatcgtcttgagtccaacccggtaagacacgacttatcgccactggcagcagcactggtaaca
ggattagcagagcgaggtatgtaggcggtgctacagagttcttgaagtggtggcctaactacggctacactagaagaacagtatttggtatctgcgctctgctgaa
gccagttaccttcggaaaaagagttggtagctcttgatccggcaaacaaaccaccgctggtagcggtggtttttttgtttgcaagcagcagattacgcgcagaaaa
aaaggatctcaagaagatcctttgatcttttctacggggtctgacgctcagtggaacgaaaactcacgttaagggattttggtcatgagattatcaaaaaggatcttca
cctagatccttttaaattaaaaatgaagttttaaatcaatctaaagtatatatgagtaaacttggtctgacagttaccaatgcttaatcagtgaggcacctatctcagcgat
ctgtctatttcgttcatccatagttgcctgactccccgtcgtgtagataactacgatacgggagggcttaccatctggccccagtgctgcaatgataccgcgagaccc
acgctcaccggctccagatttatcagcaataaaccagccagccggaagggccgagcgcagaagtggtcctgcaactttatccgcctccatccagtctattaattgt
tgccgggaagctagagtaagtagttcgccagttaatagtttgcgcaacgttgttgccattgctacaggcatcgtggtgtcacgctcgtcgtttggtatggcttcattca
gctccggttcccaacgatcaaggcgagttacatgatcccccatgttgtgcaaaaaagcggttagctccttcggtcctccgatcgttgtcagaagtaagttggccgca
gtgttatcactcatggttatggcagcactgcataattctcttactgtcatgccatccgtaagatgcttttctgtgactggtgagtactcaaccaagtcattctgagaatagt
gtatgcggcgaccgagttgctcttgcccggcgtcaatacgggataataccgcgccacatagcagaactttaaaagtgctcatcattggaaaacgttcttcggggcg
aaaactctcaaggatcttaccgctgttgagatccagttcgatgtaacccactcgtgcacccaactgatcttcagcatcttttactttcaccagcgtttctgggtgagcaa
aaacaggaaggcaaaatgccgcaaaaaagggaataagggcgacacggaaatgttgaatactcatactcttcctttttcaatattattgaagcatttatcagggttatt
gtctcatgagcggatacatatttgaatgtatttagaaaaataaacaaataggggttccgcgcacatttccccgaaaagtgccacctgacgtctaagaaaccattatt
atcatgacattaacctataaaaataggcgtatcacgaggccctttcgtc
ACCGGTCACCACCGGCACCGCACACCCATCAAGAAGACGTCAAGAAGATCAGCTGTTCAGAGCATGTCGAAGAGCGCTGCTGCGACGAAGGCTGACAGCGGCAATCGGTATCCAACACCCAGAAGATCGCCATCGCTGGCCAAGTGCCAAGTGGAGACCAAGCT
GCTGGGCAACACCCCGACCCGCACCAGCATCAAGAGCAACCTGCCCAGGAGCCCTGCTGTTCGACAGC
GGCGAAACAGCCCAGGCCGCTGGAAGATCGCCGCAGAGAAGATACGACGAG
AACCGGATCTGCTATCTGCAAGAGATCTTCAGCAACGAGATGCCAAGTGGACGACAGCTTCTT
CCACAGACTGGAAGAGTCCTTCTGGTGGAAGAGGATAAGAGCACGAGCGGCACCACCCATCTTC
GGCAACATCGTGACAGACGTGGCCTACAAGCCTGACCTGGCGTTCTATCTGCCCTGGCCCACATGATC
AACTGGTGGACAGCAGCCACAAGGCTGACCTGCCACCTGAAGCGAGACGCTGGAGAAGA
AAGTTCCGGGGCACTTCCTGATCGAGGGCGACCTGCAAGCCTGACGAGCTTCTTGAGAAGA
TGTTCATCCAGTCTGGTGCAAGCCTGTCTGCAAGGTCCTGTTCGCAGACTGAGCAAGAGCTAGCCAAGCGCAGCGCCAGCCTGACCAGCCTGACGGCATGATCAGCCCCAGCGGCAAGCCCTGACGCCAGCGCAGCCTGACGGCATGATCAGCGCACCGGCCTGACCATCCAGGACCTGTCTGGAGAAATCTGATCG
GTGACAGCAGTGCAAGGCCATCCTGCTCCAGACTGACCAAGAGCAAGAGCCTGGAGAAATCTGATCG
CCCGAGCTGCCCGGCGAGAGAGAAATGCTGTTCGGCAAGCTGGTTGCCTGAGCCTGAGCCTGGGCCTG
ACCCCCACTTCAAGAGACCAACTTCGACCTGGCGGCCCAGATGCGGCGACGGCATCCGGACCGACGTGCACGCCGAGCAAGGACA
CCTACGACGACGAGCCTGGACAACCTGTCGGCCGCCATCCTGCGACCAGCTACGCCGACGTGTTTCTG
GCCGCCAAGAACCTGTCCGAGCGCCCTCTATGATCAAGAAGATCCGAGACCAGCCTGACCCGAGATCAC
CAAGGCCCCCCTGAGCGCTCCTGATGATCAAGAAGATACGAGATACGAAGTACAAAGCACCAGGACCTGACCCTGC
TGAAAGCTCTCGTGCGGCAGCAGCTGCCTGAGCAGTGCCTGAGCAGCAAGAATTTCTTGACCAGAGCAAG |

TABLE 35-continued

| Constructs | Maps | Sequences |
|---|---|---|
| | | AACGGCTACGCCGGCTACATTGACGGCCGGAGCCAGCCAGGAGAGTTCTACAAGTTCATCAAGC |
| | | CCATCCTGGAAAAGATGAACGGCACCGAGGAACTGCTCGTGAAGCTGAACACAGAGACCTGCT |
| | | GCGGAAGCAGCGGACCTTCGACAACGGCAGCAGCATCCCCACCGATCCACCTGGAGAGCTGCAC |
| | | GCCATTCTGCGCGGCCAGGAAGATTTTTACCCATTCCTGAAGGACAACCGGGAAAAGATCGAGA |
| | | AGATCCTGACCTTCCGCATCCCCTACTACGTGGGCCCTCTGGCCAGGGGAACAGCAGATTCGCC |
| | | TGGATGACCAGAAGAGCGAGGAAACCATCACCCCTGGAACTTCGAGGAAGTGGTGACCAAGG |
| | | GCGCTTCCCGCCAAGCACAGCCTGCTGTACGATGCTTCACCGTGTATAACGAGCTGAACCAAAGTGAA |
| | | GTGCTGCCCAAGACACAGCCTGCTGTACGATGCTTCACCGTGTATAACGAGCTGAACCAAAGTGAA |
| | | ATACGTGACCGAGGAATGAGACCAACCGGAAAGTGACCCTGAAGCAGCTGAAAGAGGACTACTTCAAGA |
| | | GACCTGCTGTTCAAGACCAACCGGAAAGTGACCCTGAAGCAGCTGAAAGAGGACTACTTCAAGA |
| | | AAATCGAGTGCTTCGACTCCGTGGAAATCTCCGGCGTGGAAGATCGGTTCAACGCCTCCCTGGC |
| | | ACATACCACGATCTGCTGAAATTATCAAGGACAAGGACTTCCTGGACAATGAGGAAACGAGG |
| | | ACATTCTGAAGATATCGTGCTCGACACTGTTTGAGGACAGAGAGATGATCGGAGAACGG |
| | | CTGAAAACCTATGCCCACCTGTTCGACGACAAAGTGATGAAGCAGCTGAAGCGGCGAGATACA |
| | | CCGGCTGGGGCAGGCTGAGCCGGAAGTGATCAACGGCATCCGGACAAGCAGTCCGGCAAGAC |
| | | AATCCTGGATTTCCTGAAGTCCGACGGCTTCGCCAACAGAAACTTCATGCAGCTCACGACG |
| | | ACAGCCTGACCTTTAAAGAGGACATCCAGAAAGCCCAGGTTCTCCGGCCAGGATAGCCTGCA |
| | | CGACCACATTGCCAATCTGGCCTGCAGCCCGCCATTAAGAAGGGCATCCTGCAGACAGTGAAG |
| | | GTGGTGGAGCAGCTCGTGAAAGTGATGGGCCGGCACAGCACAGAACAGCCGCAGAATGAAGCGGATCG |
| | | CCAGAGAGAACCAGACCACCCAGAAGGACAGAGAAGAACAGCCGCAGAGAGAATGAAGCGGATCG |
| | | AAGAGGGCATCAAAGAGCTGGGCAGTCAGATCCTGAAAGAACACCCTGTGAAAAACACCCAGCT |
| | | GCAGAACGAGAAGCTTGTACCTGTACTACACGATGTGGACCACATCCTGCCTCAGAGCTTTCTGAAGGA |
| | | CTGGACATCAACCGGCTGTCCGACTACGATGTGGACCACATCGTGCCTCAGAGCTTTCTGAAGGA |
| | | CGACTCCATCGACAACAAGGTGCTGACCAGAAGCGACAAGAACGCCCGGGCCAAGAGCGACAACGTG |
| | | CCCTCCGAAGAGTCGTGAAGAAGATGAAGAACTACTGCCAGTCTGGCCAGCGCCAAGCTGA |
| | | TTACCAGAAAGTTCGACAATCTGACAAAGAGACACCTGGTGGAAACCCGGCAGATCACAAAGCACGTGGCACAG |
| | | GGCCGGCTTCATCAAGAGACACCTGGTGGAAACCCGGCAGATCACAAAGCACGTGGCACAGATC |
| | | CTGGACTCCCGGATGAACACTAAGTACGACGAGAATGACAAGCTGATCCGGGAAGTGAAAGTGA |
| | | TCACCCCTGAAGTCCAAGCTGGTGCTCCGATTTCCGAAGGATTTCCAGTTTTACAAAGTGCGCGAG |
| | | ATCAACAACTACCACCACGCCCACGACGCCTACCTGAACGCCGTGGGAACCGCCCCTGATCAA |
| | | AAAGTACCCTAAGCTGGAAAGCGAGTTCGTGTACGGCGACTACAAAGTGTACGACGTGCGGAAG |
| | | ATGATCGCCAAGAGCGAGCAGGAAATCGGCAAGGCTACGCCAAGTACTTCTTCTACAGCAACAT |
| | | CATGAACTTTTTCAAGACCGAGATTACCCTGGCCAACGGCGAGATCCGGAAGCGCCTTCGATCG |
| | | AGACAAACGGAAACCGGAGACGTGTGAGATAGGGCCGGATAAGGCGGCGCCAAGAGCTCCCCTGCGGAA |
| | | AGTCCTGAGCATGCCCCAAGTGAATATCTGAATCTGAAAAAGACCGAGTGCAGACAGGCGGCTTCAGC |
| | | AAAGAGTCTATCCTGCCCAAGAGGAACAGCGATAAGCTGATCGCCAGAAAGAAGGACTGGGACC |
| | | CTAAGAAGTACGGCGGCTTCGACAGCCCTACCGTGGCCTATTCTGTGCTGGTGGTGGCCAAAGTG |
| | | GAAAAGGGCAAGTCCAAGAAACTGAAGAGTGTGAAAGAGCTGCTGGGGATCACCATCATGGAA |
| | | GAAACCAGCTTCGAGAAGAATCCCATCGACTTTCTGGAAGCCAAGGCTACAAAGAAGTGAAAAA |
| | | GGACCTGATCATCAAGCTGCCTAAGTACTCCCTGTTCGAGCTGGAAAACGGCCGGAAGAGAATGC |
| | | TGGCCTCTGCCGGCGAACTGCAAGAGGGAAACGAACTGGCCCTCCCTGCCCAAATATGTGAACTTC |
| | | CTGTACCTGGCCAGCCACTATGAGAAGCTGAAGGGCTCCCCCGAGGATAATGACAGAAAACAGC |
| | | TGTTTGTGGAACAGCACAAGCACTACCTGGACGAGATCATCGAGCAGATCAGCGAGTTCTCCAAG |
| | | AGAGTGATCCTGGCCGACGCTAATCTGGACAAAGTGCTGTCCGCCTACAACAAGCACCGGATAA |
| | | GCCCATCAGAGAGATACTTTGACACCACCATCGACCGTAATATCATCCACCTGTTTACCCTGACCAACCTGGG |
| | | CCCCTTCAAGTACTTTGACACCACCATCGACCGGAAAAGGTACACCAGCACCAAAGAGGTGCTG |
| | | GACGCCACCCTGATCCACCAGAGCATCACCGGCCTGTACGAGACACGGATCGACCTGTCTCAGCT |
| | | GGGAGGCGACggtggcgagaagcggaagaaaaagaaggtcggagaaggcggaggaagcggaggaaggagtag |
| | | cagcgtgatcaacatccagtgcagactggtgccgaagaggacatcctgagcagctgtgggagcctgatggccgacaagaggaaggactgg |
| | | gctggccccaagtgggaaagcaccccgaagcagcaccccaagcagcctttgagacgttgagacatgggtcccaccacgttgagacaacagccgaataaacccaacagtcaagaaacgccacccgaagaacagccagagaacagcc |
| | | agagagattcgccagccagccagcagcagccccacctgcagcaggagcagcagcagcagagaagctgttcgcctgagagacgtcgtctgtggactacgtcaagaggacacgaggaaagac |

TABLE 35-continued

Figure 84:
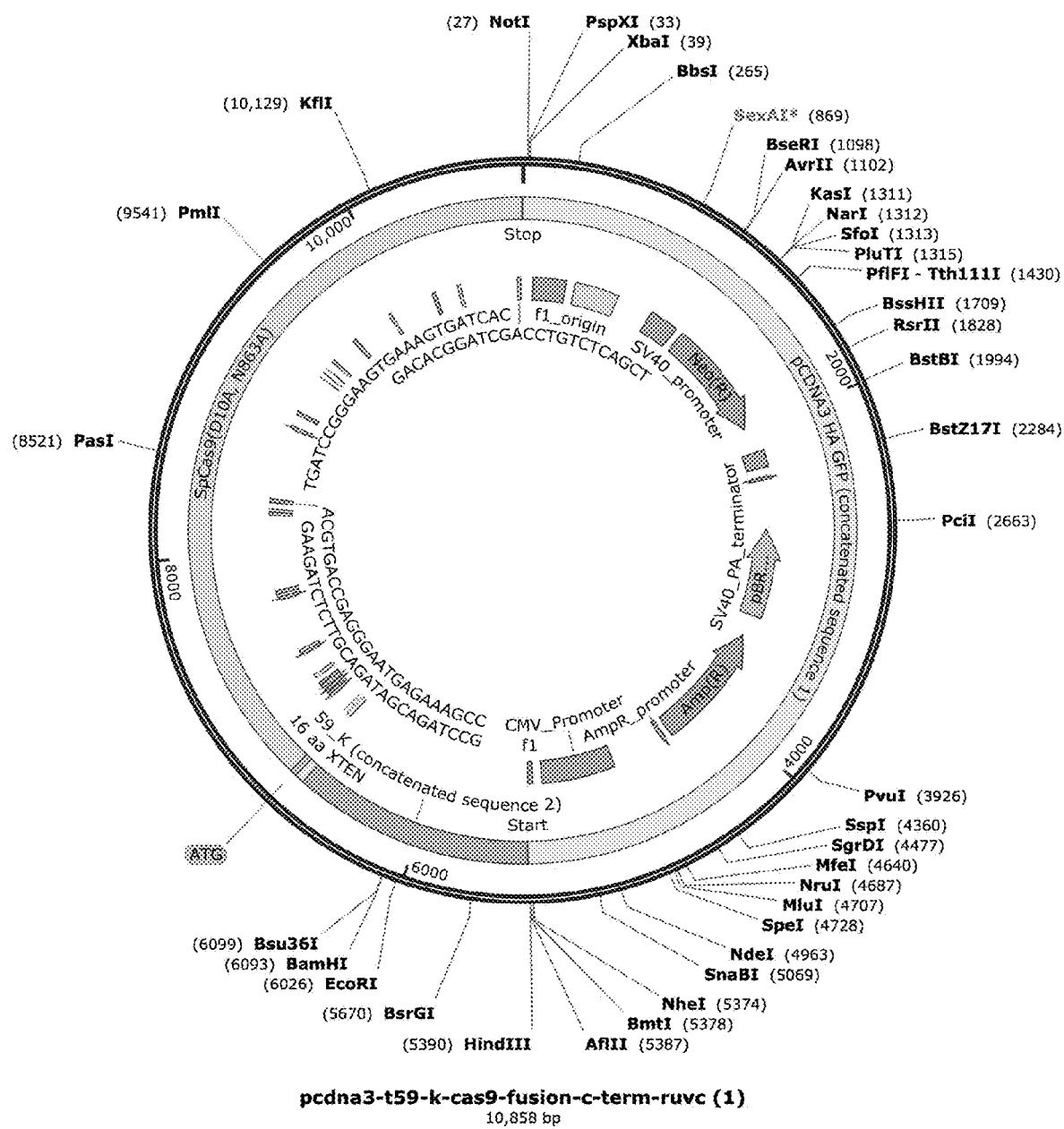

| Constructs | Maps | Sequences |
|---|---|---|
| | | agatcgagggcaaagagagatggctgaccatcctgaagtccgacctgaacaagagtccccagtgtagcctgagcgccatcaggaccaaggccaac |
| | | gagatcctgacagttcaacccctacgagcgacaccagagccagcgagcagaacaagaaccagcgaggaggcaaaagaccaagaagtccaccaagtccagcctgtt |
| | | cagatcctgctgaccacctacagcagcacccagagaatcctgcacgatcgagatcgagcgccattgcctactcctgaagaacaactgcgacatcagcgagctgacgag |
| | | gacagcgaggaattcaccaagaaccgcggaaacgagagattgagtgagcgcctgaagaatcagtcgagcaggaatcctaagggcagagattgac |
| | | cgcgaggagaatggctcaagacccgaaatcagcacgcgaacgatcagcaccaaggctgcaaggctgcaaggctgaggaaaagc |
| | | gccgactgccattcctgtggcctacaaggcgatctgcagacaaccggctgcgactcaattcaaggcggttctgcaggttctgcgcgttcaagcgctggcaag |
| | | ctgttcacccgtgagggtttgaggtgactgcttggagccctggagcgagcgactgcaagacgagcgaacctgaaggcgaccatgtgaaccagtgtactgcacctgaacc |
| | | agaatgttgaaccagcagccagctgcaggaggcacaaccaagcaagcaagcaacaagcaactgaacg |
| | | accagcaggcctcatcaccagacagcagcctgtgacagtcgcgtgtgacgtcaaccatctgtcccagagacatgaggtgctgtcctacagaaggcagatacccaggccaagctgcgg |
| | | cctcgtgggcgtcctggctcgaaagctcgacgcgacacagcacagcagcaccatccgtcacgcagcagagaactcgacaagcgcccaacagtgctg |
| | | gcgagaactacaatctgctgaccgtacatcgcagactggctgacgcagcgagatcatgtgccaagcataccagcgctcacgtccagcgctgagag |
| | | cgatctgagtcgaccgtactacgacaggccactgaccgagaggcagatccagtgcatcaaggcccatcgtgagatctacacagatcggcagaatacgat |
| | | atatgagagcagatcagcagagatccaagaaggtgcaccatgtatatacgaggcagagaaaggcgatctctacagcagcgggaagggtcgacctgaca |
| | | gagcgtcaccgtggcctcaggcagaagtcgactgccgtcgctgcgctcaccagaacagaagacccaggagatgcagcaacctgaacg |
| | | gcctcctccaagagaccagaagccagatggtgcctgttcgcctaccaagacaggccgctctgcatccggg |
| pcdna3-t59-k-cas9-fusion-c-term-ruvc (SEQ ID NO: 927) | FIG. 84 | aattctgcagatatccagcacagtggcggccgcggcgtctagagggcctagaggctcactccgatcagccttaaaccgcgatcagcctgcgctgactcctgagtgcgctctagtgcagccatctgtgttt |
| | | gccctccccccgtgccttcttgaccctggaaggtgccactcgaaggtgccaatgtcctctcctaataaatggaatgtgcagttgccatggtgcatttctgatatattctg |
| | | gggtggggtgggggcaggacagcaagggggaggattgggaagacaataacatgcggggtgggatggtgctcatgctccctatgggcagtcctgcagcgaaaatgcttctgccatcatcgatcgaggaatgttgccagg |
| | | ccagctgggcctagggggctctccccgcgtcctccttcctctctcgcacgttcgccacgtgcgccagctctcgcgcgccgccttaaccggtggccagtgcgctaaatcggggctcctcaaatcggggctcttccgcttaggtctccgattcgatgtcttt |
| | | aggcagcctcgaccccaaaaactcctgattaggtgctatacactcactccggtgatctagcagcagcggaaacgtgctcaaatcgggctccttgccgattctctcgtttcgcttagtctcactgcttcgattagtcagttcaggtcccatgcgctt |
| | | tagtggacctctgtttccaaactggatacaacactcaacctatcctcggtctagtttggcctatcttcgtcagttcggccatctggccgattctcggcgatcaaagtatgcaaagatgcaaagatgcatgcatccaatt |
| | | aacaaaaatttaagcggaattaattctgtgaaagtcccagctgcacagcagatatcaacagtatgcaaagcgatcaaagtatcaaccatagcccgccccaactccgagcatcagatt |
| | | agtcaagaacagtgtgaaaacctcgccagtccccagctccgcccagtccgcccagtcagtgcagagatgccctaaatcgatgcgagtccaatgcgcaggtcgcgcc |
| | | cccatccgcctaactcgcggcagtcccgcagctccgcgagccaccgcatctccgcaaaagctctccccggagcgcagctctcgcgccaccatatccatccctatccctgtgctattcc |
| | | agagagggcagaggggtttttcgggagccagacctctgcatgtgcaggggcaaaaacgcccctgaacacaggagacctcgtcagagtgcaatccgtccaagccaagaagagctattgtcccggatcgagaagagagagatcgcttcc |
| | | ccgttccggacgactgcagccaggtttgcgccgattctctttgcagcagcgacgcgacagcgacagccaaatcatggctgccaatgctgaattcgactcatcgact |
| | | gcgcgcgctgggccgtgcggtgccgggagcgctatcagacagacagcagacaatcgcagcagacagtgcaacagctctcgaagatgctggcggcaatgctccaggctgaatgctcaggctctgcgtgcaatgctcaggctctcgcgtct |
| | | acggtatccgcctccccgatcgcagccgcatcgcctcatgaaaggtccgatcgtttccggacggactgtttcctgggatcgacgatcgtttccggacggactgtttcctgggatcgacgatcgtttccggacggactgtttcctgggatcgacgcc |
| | | tcatgctgagtccgcaactcttccctgattgtattggctcagtcttatcgcagatgctcggggcagtttccggacggacctgccaacaattccaacaatttttttcactgcatct |
| | | agtgtggttcgccaaatccaccaacatacaagccgacagcagcagcagcagacctgctgagaaggcggaacgatcatggctctaatcatgttcgtcagcaggacatctttcctgggaatcgtcctgcggtgaattgtta |
| | | tcgctcacaattccaacaaccgtcgccagcgcagccaatcggaagcggcagcgcagcaccaagcagcgctgaactacatcagcacatcagcaacaacagagcatagccagcagcaaccgatgctgggcctcatgcc |
| | | gctttccagtcagagtcagtgcctgcctgccgcgaagccagcggcttttccatagctccgccgcgtcggtgcctgcagctcacaagcgccggcctaccactg |
| | | actacgtccgctcgcgtctgccctgctgtgcccagaaccagaacaagggctgctgcctcagcctagcctccaaggtgctactcaagcggcctagacaagtatcccaagaagggtatccccaaggaataaccagcaagaagaacg |
| | | gtgagcaaagagcagcaaggcagaaccgagacgactatccaaaagatcgaaaaaaagatatcaaagtaccgcctaacctcggagtcatcatcatgcccatgcgcctgtcgttacagcatgcaccatgggtg |
| | | tcaagtcagaggtggcgaaaccaggcagaaccgaagcggctcccatcagcggctaggtatctcagtcgtggctatctcggagtctgcatggtctcgccagctggctggctgtgcacg |
| | | tacctgtccgctttcgcctgtccccttcggaggcgggccttgccgctatcggctacacacaggcggttgcgcagtctcgtgcaacacgggctcgaa |
| | | aaccccgcgcgtcgcagagctacgatgggctgcctatcggtgcctaactcgaaggtgccctaactacgaagacgtcactcactggtcctatcgcgctctgcgaa |
| | | ggattagcgcagcgaggtatgtaggcggtgctacagatttccgaaggtcagcctcggcaactcgccgcagcagcccgctgcagcggacggctcactgggctcctcgacggctgcgctgtaa |
| | | gccagtaccttcggaaaaagacctcggagcctcggagcagctgcctcggaccctgatccgcaaagccgctggaacaaaaccacgttaaggagaaggtttgttcaagcagcagattacgcagaaa |
| | | aaggactccaagaagacctcttgatcttttcaccggggttgatcatcaaatcaatgaagtttaaatcatcctaaagtatatatgagtaaactggtctgacagttaccaatgcttaatcagtgaggcaccctatctcagcgat |
| | | ctagatccccttattcgttcatccatagtgctgcctgactcccgtcgtaaccgtagctcttaaatgaactctagaacaaactatacgatatgaactaaacaacctctggcccgtcgttgagaaccatagtgagccgaccc |

TABLE 35-continued

| Constructs | Maps | Sequences |
|---|---|---|
| | | acgtcaccggctccagatttatcagcaataaccagccagccagcgaaggccgagcgcagaagtggtcctgcaacttatcgcctcatccagtcattaattgt |
| | | tgccgggaagctagagtaagtagttcgccagttagttcgccagttgccaaggcatcgtgctacaggcatcgtggtgtcacgtcgtgttgtatggcttcattca |
| | | gtccggttcccacgatcaaggcgagttacactgatccccatgttgcaaaaagcggttagctccttcgtcctccgatcgtgtcagaagtaagttggcgca |
| | | gtgttactcatggttatggcgagcactgcataattccttactgtcatgccatcgtaagatgctttctgtgactggtgagtactcaaccaagtcattctgagaatagt |
| | | gtatgcggcgaccgagttgctctgcccggcgcaataccgggataatacccgcacatgcaccactgtaaagtgctcatcattgaaaacgttcctcggggcg |
| | | aaaactcaaggatcttaccgctgtgagatccagtcgatcgtgaacccactcgtgcaccactgatctactctctttcaatattatgaagcattatcaggttatt |
| | | aacaggaaggcaaaatgccgcaaaaaaggaataaggcgcacgaacaaatagggggttccgcacatttcccgaaaaagtgccacctgacgtcgacgatcggaga |
| | | gtctcatgagcggatacatattgaattgtattagaaaaaataaaactcgaactctcgtgccgatccgctgcgcagtatcgctgtgttggaggtcgtagtagcgcga |
| | | tctcccgatccctatgtgcactctcagtacctcagtgccgacaattgcatgaagaatctgcatgagagcaagctgccaaaatttaagcacaacaaggcaaggt |
| | | gcaaaatttaagctacaacaaggcaaggcttgaccgacaaattgcatgaagaatctgcatgaagaatctgaagaatctgagcaagccgaagacgtagatac |
| | | gcgttgcattgacttattgacttagttcccgccaacgacccccgccgacgtacggtatgtccccatagtaacgccaatagggacttccattgacgtaagctgagtattac |
| | | tgctgaccgcccaacgaccccccgccaacgaccccccgtcatatgacgcgtatcggtatatgctatactagtaacgccaatagggactttccattgacgtcaatgggt |
| | | ggtaaactgcccacttggcagtacatcaagtgtatcatatgccaagtatgccccctattgacgtcaatgacggtaaatggcccgcctggcattatgcccagtacatg |
| | | acctatggaactttccccactttccactttccactgcagtacatctacgtattagtcatcgctattaccatgtgatcgctattaccatggtgatgcggttttggcagtacatcaatgggcgtggatagcggtttgactc |
| | | acgggatttccaagtccaccacccattgacgtcaatgggagtttgttttggcaccaaaatcaacgggactttccaaaatgtcgtaacaactccgccccattgacgc |
| | | aatgggcggtaggcgtgtacggtgggaggtctatataagcagagctctctggctaactagagaacccactgcttactggcttatcgaaattaatacgactcactat |
| | | aggagaccaagccgttcagcgttaaattaagctcaccacccttaaagctcgacgcagtatcaacccagtcatcaacaagtcatcaacaagtcacaacaccccagttgagacatggcaga |
| | | ctggggagctgatggccgacaagaacaccccctgtcaacaagccctctgatcaacaagatgcaagagcctgtctggcccaagagagattctgctgtctgcagtggcaga |
| | | atccccaccaagctgctgaaaactcggactcttaagcttgccaccATGagctgtatcaccatccagtgacgactttggaagcattctacacctttggcctcgctggtggac |
| | | tacgtgtacaagagttggttccgccctcggcaggcgggagagacagatcgaggcggaaggcaagcagcccaaagaagcagaagcagaacctcaggtgctgaccatcctgaaggacagaaccagccagctggaa |
| | | caagagtccagtgagctagccgaaccgaaccaaggccaagatcgtgctcaagaagctgcgatcgaaccgctcccagagcgaggcagcagaaccagcaccgccacgggaaggg |
| | | caaaagaaccaagaagtccaccaagccgaagccgaagaagaagagcagagcaagccgagcaagccagaagcagagacccagaatctctgaccagatgcgccattg |
| | | cctacctgtgaagaacaactgccagatcagccctaaggcgacaggatcagccggacaggatctgacccgcgaggaatgctcaagacctcctggctacgagatcagcccagaacga |
| | | aagatcagctcgaggacaggatcagccggatctgcaagccgtctgtgaaaaaaggcgacttcctgtgcctacgaggacaaccgacaaccagcagcaaccagagaacgtgccaacga |
| | | gaatgaagccaagcctggcaagcgtgtctggcgtcaagccgttaaacaagagcggaccaagcctgctcatccgaatcatctgaccctctactgccactacctgaaccgttctcgagg |
| | | cgacaaggcagactgttcgtgggttcaagcgccctgggcaagcagtacagcagtcctcttcacctgcgcagtggagctcaccctggaatggaaacctcaagcggttcctcgagga |
| | | ccaagagctgaaggcggaaccaccagaggcaacctgtactgcaccctggacaccagatgacctgaacccagcaggcgactgaactgcagcagagaaccagccagaaggggagcc |
| | | ctgaaacctgaccagtcgacaaggccaagctgaccgccctgaccagaaccagccaaccgccagcgggacctgctctctgaaaagccgagaagcagacgagcagcacactgacAGCGGCGAGC |
| | | cgaaacctcgacactggcagtctcgacacactggcagttccagcctaaggatacttccgaggatgtcggccggagagtcggtgggcggaaagcggcG |
| | | GAGACTCCCGGGACCTCAGAGTCGCCCACACCCGAAAGTcaaagaagacggaagtggtgcgccgtgggcggaagcggcG |
| | | ACAAGAAGTACAGCATCGGCCTGCCATCCAGGAATTCAAGGTGCTGGGCCAACACCGGCACAGCATCAAGA |
| | | GAGTACAAGGTGCCCAGCAAGAATTCAAGGTGCTGGGCCAACACCGGCACAGCATCAAGA |
| | | AGAACCTTGATCGAGCCCTGCTGTTCGACAGCGGCGAAACAGCCGAGCCACCCGGCTGAAGAG |
| | | AACCCCAGAAGAAGATACACGGACAACCGGATCTGCTATCTGCAAGATCTTCAGC |
| | | AACCAGATGCCAAGGTGACGACAGCTTCTTCCACAGACTGAAGAGTCCTTCCTGGTGAAG |
| | | AGGATAAGAAGCACGAGCGGCACCCCATCTTCGGCAACATCGTGGACGAGGTGGCCTACCACGA |
| | | GAAGTACCCCACCATCTACACCTGAGAAGAACTTGGTGGACAGGAAGAACCCACCAAGGCCGACCTG |
| | | CGGCTGATCTATCTGGCCCTGGCCCATGATCAAGTTCCGCGGCCACTTCCTCATCGAGGGCGA |
| | | CCTGAACCCCGACAACAGCGACGTGGACAAGCTGTTCATCCAGCTGGTGCAGACCTACAACCAGC |
| | | TGTTCGAGGAGAACCCCATCAACGCCAGCGGCGTGGACGCCAAGGCCATCCTGTCTGCCAGACTG |
| | | AGCAAGAGCAGACGGCTGGAAAATCTGATCGCCCAGCTGCCCGGCGAGAAGAAGAATGGCCTGTTT |
| | | TCGGCAACCTGATTGCCCTGAGCCTGGGCCTGACCCCCAACTTCAAGAGCAACTTCGACCTGGCC |
| | | GAGGATGCCAAACTGCAGCTGAGCAAGGACACCTACGACGACGACCTGGACAACCTGCTGGCCC |
| | | AGATCGGCGACCAGTACGCCGACCTGTTTCTGGCCGCCAAGAACCTGTCCGACGCCATCCTCTGCTG |
| | | AGCGACATCCTGAGAGTCAACACCGAGATCACCAAGGCCCCCCTGAGCGCCTCTATGATCAAGA |
| | | GATACGACGAGCACCACCAGGACCTGACACTCTTTCGACAGAGCCAACTTCGACCTCGTGACCTGAG |
| | | AAGTACAAAGAGATTTCTTCGACAAGTTCTACAAGTCTTCATCCAGAGCAAGAACGGCTACGCCGGTACATTGACGGCACCGGAG |
| | | CCAGCCAGGAGAGTTTCTACAAGTTCTACAAGTTTCATCCAGAGCAAGAACGGCTACGCCGGTACATTGACGGCACCGGAG |
| | | ACTGCCTCCGTGAAGCTGAACAGAGAGGACCTCTCGCGCGCAGGAGAAAATGAGCGCAGCAGCCTGACAACGGCAGC |
| | | ATCCCCCACCAGATCCACCTGGGAGATCCACCTGAGAGGAAATCGAGAAGATCCTCACCTTCCGACTCGACAACGTACGTGG |
| | | ATTCCTGAAGGACAACCGGGAAAAGATCGAGAAGATCCTCACCTTCCGACTCGACAACGTACGTGG |

TABLE 35-continued

| Constructs | Maps | Sequences |
|---|---|---|
| | | GCCCTCTGCCAGGGAAACAGCAGATTCGCCTGGATGACCAGAAAGAGCGAGGAAACCATCAC |
| | | CCCTGAAACTTCGAGGAAGTGTGACAAGGCGCTTCCGCCCAGAGCTTCATCGAGCGATGA |
| | | CCAACTTCGATAAGAACCTGCCCAACGAGAAGTGCTGCCAGCAGCCTGCTGTACGAGTAC |
| | | TTCACCGTGTATAACGAGCTGACCAAAGTGAATACGTGGAGGAATGACAAGCCCGCCT |
| | | TCCTGAGCGGCGAGCAGAAAAAGGCCATCGTGGACCTGCTGTTCAAGACAACCGGAAAGTGAC |
| | | CGTGAAGCAGCTGAAAGAGGACTACTTCAAGAAAATCGAGTGCTTCGACTCCGTGGAAATCTCCG |
| | | GCGTGGAAGATCGGTTCAACGCCTCCCTGGGCACATACCACGATCTGCTGAAGATATCAAGGAC |
| | | AAGGACTTCCTGGACAATGAGGAAAAACGAGGACATTCTGAAGATCGTGTCTGACCCTGACACT |
| | | GTTTGAGGACAGAGAGATGATCGAGGAACGACATGCCACCTGGGGCCTGAGCCTGTTCGACGACAAA |
| | | GTGATGAAGCAGCTGAAGCGGCGGAGATACACCCGGCTGGGCGCAGGCTGAGCCGAAGCTGATCA |
| | | ACGGCATCCGGGACAAGCAGTCCGGCAAGACAATCCTGGATTTCCTGAAGTCCGACGGCTTCGCC |
| | | AACAGAAACTTCATGCAGCTGATCCACGACGACAGCCTGACCTTTAAAGAGGACATCCAGAAAG |
| | | CCCAGGTGTCCGGCCAGGGCGATAGCCTGCACGAGCACATTGCCAATCTGGCCGCAGCCCGCC |
| | | ATTAAGAAGGGCATCCTCAGACAGTGAAGGTGTGGACGAGCTCGTGAAAGTGATGGGCCGGC |
| | | ACAAGCCCGAGAACATCGTGATCGAAATGGCCAGAGAGAACCAGACCACCCAGAAGGGACAGA |
| | | AGAACAGCCGCGAGAGAATGAAGCGGATCGAAGAGGGCATCAAAGAGCTGGGCAGCCAGATCC |
| | | TGAAAGAACACCCCGTGGAAAACACCCAGCTGCAGAACGAGAAGCTGTACCTGTACTACCTGCA |
| | | GAATGGGCCGGATATGTACGTGGACCAGGAACTGGACATCAACCGGCTGTCCGACTACGATGTG |
| | | GACCACATCGTGCCTCAGAGCTTTCTGAAGGACGACTCCATCGACAACAAGGTGCTGACCAGAAG |
| | | CGACAAGGCCCGGGCCAAGAGCGACAACGTGCCCTCCGAAGAGGTCGTGAAGAAGATGAAGA |
| | | CTACTGGCGGCAGCTGCTGAACGCCAAGCTGATTACCCAGAGAAAGTTCGACAATCTGACCAAGG |
| | | CCGAGAGAGGCGGCCTGAGCGAACTGGATAAGGCCGGCTTCATCAAGAGACAGCTGGTGGAAAC |
| | | CCGGCAGATCACAAAGCACGTGGCCAGAATCCTGGACTCCCGGATGAACAACTAAGTACGACGAG |
| | | AATGACAAGCTGATCCGGGAAGTGAAAGTGATCACTCTGAAGTCCAAGCTGGTGTCCGATTCCG |
| | | GAAGGATTTCCAGTTTTACAAGTGCCACCACCGCCCACGACGCCTACC |
| | | TGAACGCCCTCGTGTGGAACAAGCTGCTGATCAAAAAGTGATCTAAGCTGAAAGCGAGTTCGTGTAC |
| | | GGCGACTACAAGGTGTACGACGTGCGCGAAGATGATCGCCAAGAGCGAGCAGGAGAAATCGGCAGG |
| | | CTACCGCCAAGTACTTCTTCTACAGCAACATCATGAACTTTTTCAAGACCGAGATTACCCTGCCA |
| | | ACGGCGAGATCCGGAAGCGCCCTGATCGAGACAAACGGCGAAACCGGGAGATCGTGTGGGA |
| | | TAAGGCCGGGGATTTTGCCACCGTGCGACAAGTGCTGAGCATGCCCCAAGTGATATCGTGAAAA |
| | | AGACCGAGGTGCAGAAAGGCGGCTTCAGCAAAGAGTCTATCCTGCCCAAGAGGAACAGCGATAA |
| | | GCTGATCGCCAGAAAGAAGGACTGGGACCTTCAAGAACTGGAAGGCGGTTCCAAGAGCTGTGA |
| | | GCCTATTCTGTGCTGGTGTGGCCAAAGTGGAAAGAGGCAAGTTCAAGAAACTGAAGAGTGTGA |
| | | AAGAGCTGCTGGGGATCACCATCATGAAAGAGAGCAGCTTCGAAAGATTCCATCGACTTTCTG |
| | | GAAGCCAAGGGCTACAAAGAAGTGAAAAAGACCTGCTCTGCCCGGCGAACTGCAGAAGGGAAACGA |
| | | TCGAGCTGGAAAACGGCCAAATATGTGAACTTCCTGTATCTGGCCAGCCACTATGAGAAGCTGAAGG |
| | | GCTCCCCCGAGGATAATGAGCAGAAACAGCTGTTTGTGGAACACGACACTACCTGGACGA |
| | | GATCATCGAGCAGATCAGCGAGTTCTCCAAGAGAGTCTCCGCCGACGCTAATCTGGACAAAG |
| | | TGCTGTCCGCCTACAACAAGCACCGGGATAAGCCCATCAGAGAGCAGGCCGAGAATATCATCCA |
| | | CCTGTTTACCCTGACCAATCTGGGAGCCCCTGCCGCCTTCAAGTACTTTTGACACCACCATCGACCG |
| | | GAAGAGGTACACCAGCACCAAAGAGGTGCTGACGCACCCCTGATCCACCAGAGCATCACCGGC |
| | | CTGTACGAGACACGGATCGACCTGTCTCAGCTGGGAGGCGACTAA |

TABLE 35-continued

Figure 85:
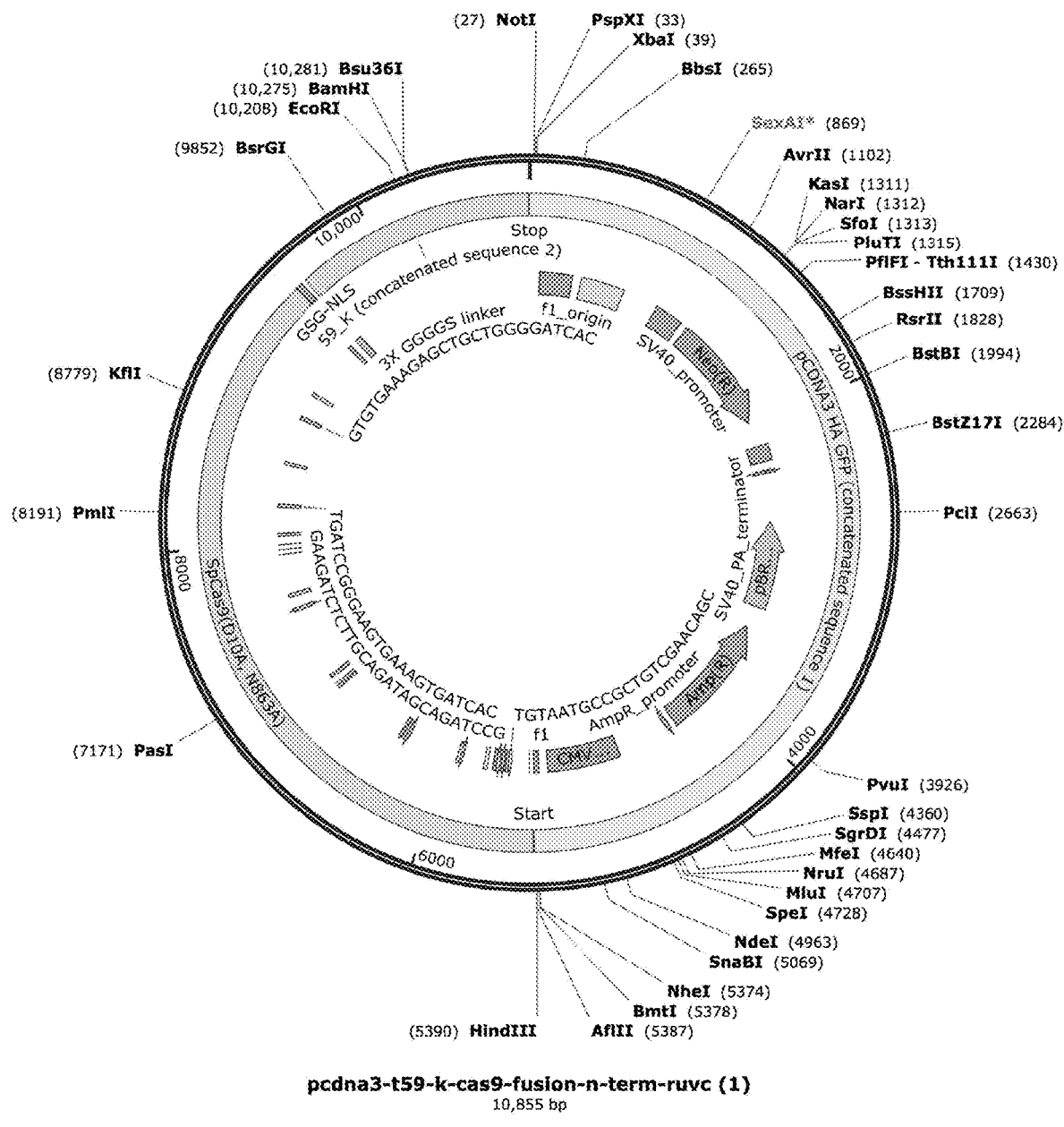

| Constructs | Maps | Sequences |
|---|---|---|
| pcdha3-t59-k-cas9-fusion-n-term-ruvc (SEQ ID NO: 928) | FIG. 85 | aattctgcagatatccagcacagtggcggcgctcgagtctagagggcccgtttaaacccgctgatcagctcgactgtgccttctagttgccagccatctgttgtt gccctccccgtgccttcttgaccgtgagaaggtgcactccactgtccatccaataaaattgcatgattgtctgattgtctgattgtcattctattctg ggggtgggttggggcaggacagcaagggggaggattgggaagacaatagcaggcatgctggggatggcggcgttctatgcttctgaggcggaaaga ccagctgggtcctaggggtatcccacgccctcgccttcgctccccgccgcgtgcggcagtcgagtgccgatcgggtcgtacgcgcatcctgccagc ccctagcgcccgctccttcgctttgcttctccccttcttgcgcacgttcactggttgcggggatggccatcttggagcggccatctttgacgttagtgctt acggcacctcgacctcgaccccaaaaactgattaggtgatggtcacgtagtgggctctattctttgattataagggatttgcgatcggcctatggtaaaaatgagctgatt tagtggactcttgtccaactggaacaacactccaacctatctcggtctattctttgattataagggatttgcgatcggcctatggtaaaaatgagctgatt aacaaaatttaacgcgaattaattctgtggaatgtgtgcagttgggtgaaagtccaggctggtgcagcagaagtatgcaaggtaccccccactccg agtcccagcaagtgtgaaagtcccaggccgcgtgagaagtatgcaacagtgatcatccaattagtccgcccctaactcg cccatccgccctaacccgccagtccgccatctcgcgtctcgggcctgcaaaagctcccggggctgtctatccaattttttattatcgcagagcggagcgggatcgttc agaagtagtgaggaggcttttttggagcctcaaggctcttgtttgcaagatccaaggtctatggcttgcacaacagacatcggtgctgcttgtgg catgattgaacaagatggattgcacgcaggttctccgccaagtcgcacctgtgcctttttgcaaggacccaacgacagacaatcggtgctgttg cgtgttccgacgtgacgggtcctcgctcctccgagaaagatccatcgtgctgatgagcgtctgtttgcgatgatcatgggactgaagacgtctcagg ctgccagacagggcgcgcagggcccgagactcaagctctgctgcaaatcatgtgaaatgaatgcagatcattgaactcatcgact gtgccgtggtgtggggacgtgactatcagcaggacatagcttgcccaatgcggcctgcccattcatccagcggtatcgtagcgcaggcttctgtg aa attcaacctgtcctccgagaaagatcctcatggctgtgatgagcggtttgtgtcgacagatcatcaggagcatcaggggttctgagcttcgc caga acctgcactcacgagattcgattccaccgccgcctttgcttgatgagtgaaacgttccggacacgcgtagtttattatcactaatgagcgatcggacgggatc ttgctgggagtcttcgccacaccacccatctgttattcgagtaaatgataaccattcacaataagcatcaactgattgcatagaagctttctaatgcattct agtgtgttgttgcccaaactccacactcatcatgatatccgcgaagctgtatcatgtaccgcctagagctgcgacttgaaatgacttcacagcattct tcgctcacaaattccacacaacatacgagccggaagcataaaagtgtaaagcctggggggtgcctaatgagtgagctaactcacattaattgcgttgca gcctcactgcccgcttctagtcgggaaacctgtcgtgccagctgcattaatgaatcggccaacgcgcgggagaggcggtttgcgtattgggcgc tcttcggtcctcagtctgagctgcggcgagcgtatcagctcactcaaaggcggtaatacggttatccacagaatcaggggataacgcaggaaaga acatgtgagcaaaaggccagcaaaaggccaggaaccgtaaaaaaggccgcgttgctggcgtttttccataggctcgccccccctgacgagcatcacaaaaatcgacg ctcaagtcagaggtggcgaaacccgacaggactataaagataccaggcgtttccccctggaagctccctcgtgcgctctcctgttccgaccctgccg cttaccggatacctgtccgcctttctcccttcgggaaagcgtggcgctttctcatagctcacgctgtaggtatctcagttcggtgtaggtcgttcgctccaagctgggctgtgtgcacg aaccccccgttcagcccgaccgctgcgccttatccggtaactatcgtcttgagtccaacccggtaagacacgacttatcgccactggcagcagccactggtaaca ggattagcagagcgaggtatgtaggcggtgctacagagttcttgaagtggtggcctaactacggctacactagaagaacagtatttggtatctgcgctctgctgaa gccagttaccttcggaaaaagagttggtagctcttgatccggcaaacaaaccaccgctggtagcggtggtttttttgtttgcaagcagcagattacgcgcagaaaa aaaggatctcaagaagatcctttgatcttttctacggggtctgacgctcagtggaacgaaaactcacgttaagggattttggtcatgagattatcaaaaaggatcttca cctagatccttttaaattaaaaatgaagttttaaatcaatctaaagtatatatgagtaaacttggtctgacagttaccaatgcttaatcagtgaggcacctatctcagcgat ctgtctatttcgttcatccatagttgcctgactccccgtcgtgtagataactacgatacgggagggcttaccatctggccccagtgctgcaatgataccgcgagacc cacgctcaccggctccagatttatcagcaataaaccagccagccggaagggccgagcgcagaagtggtcctgcaactttatccgcctccatccagtctattaattgt tgccgggaagctagagtaagtagttcgccagttaatagtttgcgcaacgttgttgccattgctacaggcatcgtggtgtcacgctcgtcgtttggtatggcttcattca gctccggttcccaacgatcaaggcgagttacatgatcccccatgttgtgcaaaaaagcggttagctccttcggtcctccgatcgttgtcagaagtaagttggccgca gtgttatcactcatggttatggcagcactgcataattctcttactgtcatgccatccgtaagatgcttttctgtgactggtgagtactcaaccaagtcattctgagaatagt gtatgcggcgaccgagttgctcttgcccggcgtcaatacgggataataccgcgccacatagcagaactttaaaagtgctcatcattggaaaacgttcttcggggcgaa aactctcaaggatcttaccgctgttgagatccagttcgatgtaacccactcgtgcacccaactgatcttcagcatcttttactttcaccagcgtttctgggtgagcaa aaacaggaaggcaaaatgccgcaaaaaagggaataagggcgacacggaaatgttgaatactcatactcttcctttttcaatattattgaagcatttatcagggttatt gtctcatgagcggatacatatttgaatgtatttagaaaaataaacaaataggggttccgcgcacatttccccgaaaagtgccacctgacgtcgacggatcgggaga tctcccgatcccctatggtgcactctcagtacaatctgctctgatgccgcatagttaagccagtatctgctccctgcttgtgtgttggaggtcgctgagtagtgcgcga gcaaaatttaagctacaacaaggcaaggcttgaccgacaattgcatgaagaatctgcttagggttaggcgttttgcgctgcttcgcgatgtacgggccagatatac gcgttgacattgattattgactagttattaatagtaatcaattacggggtcattagttcatagcccatatatggagttccgcgttacataacttacggtaaatggcccgcc tggctgaccgcccaacgacccccgcccattgacgtcaataatgacgtatgttcccatagtaacgccaatagggactttccattgacgtcaatgggtggagtatttac ggtaaactgcccacttggcagtacatcaagtgtatcatatgccaagtacgccccctattgacgtcaatgacggtaaatggcccgcctggcattatgcccagtacatg accttatgggactttcctacttggcagtacatctacgtattagtcatcgctattaccatggtgatgcggttttggcagtacatcaatgggcgtggatagcggtttgactc acggggatttccaagtctccaccccattgacgtcaatgggagtttgttttggcaccaaaatcaacgggactttccaaaatgtcgtaacaactccgccccattgacgc aaatgggcggtaggcgtgtacggtgggaggtctatataagcagagctctctggctaactagagaacccactgcttactggcttatcgaaattaatacgactcactat agggagacccaagctggctagcgtttaaacttaagcttggtaccgagctcggatccactagtccagtgtggtggaattctgcagatATGATGGACAAGAAGTACAGCATCGGCCTGGCCATCGGCA |

TABLE 35-continued

| Constructs | Maps | Sequences |
|---|---|---|
| | | CCAACTCTGTGGGCTGGGCCGTGATCACCGACGAGTACAAGGTGCCCAGCAAGAAATTCAAGGT |
| | | GCTGGGCAACACCGACCGGCACAGCATCAAGAAGAACCTGATCGGAGCCCTGCTGTTCGACAGC |
| | | GGCGAAACAGCCGAGGCCACCCGGCTGAAGAGAACCGCCAGAAGAAGATACACCAGACGGAAG |
| | | AACCGGATCTGCTATCTGCAAGAGATCTTCAGCAACGAGATGGCCAAGGTGGACGACAGCTTCTT |
| | | CCACAGACTGGAAGAGTCCTTCCTGGTGGAAGAGGATAAGAAGCACGAGCGGCACCCCATCTTC |
| | | GGCAACATCGTGACAGCACCACCGAAGAGTGCGACCTGCGGCTGATCTATCTGCCCCTGAGAAGA |
| | | AACTGGTGGACAGCACCAAGGCCGACCTGCGCCTGATCTATCTGGCCCTGGCCCACATGATCA |
| | | AAGTTCCGGGGCCACTTCCTGATCGAGGGCGACCTGAACCCCGACAACAGCGACGTGGACAAGC |
| | | TGTTCATCCAGCTGGTGCAGACCTACAACCAGCTGTTCGAAGAAAACCCCATCAACGCCAGCGGC |
| | | GTGGACGCCAAGGCCATCCTGTCTGCCAGACTGAGCAAGAGCAGACGGCTGGAAAATCTGATCG |
| | | CCCAGCTGCCCGGCGAGAAGAAGAATGGCCTGTTCGGCAACCTGATTGCCCTGAGCCTGGGCCTG |
| | | ACCCCCAACTTCAAGAGCAACTTCGACCTGGCCGGAATGCCCAAACTGCAGCTGAAGCAAGGACA |
| | | CCTACGACGACGACCTGGACAACCTGCTGGCCCAGATCGGCGACCAGTACGCCGACCTGTTTCTG |
| | | GCCGCCCAAGAACCTGTCCGACGCCATCCTGCTGAGCGACATCCTGAGAGTGAACACCGAGATCAC |
| | | CAAGGCCCCCCTGAGCGCCTCTATGATCAAGAGATACGACGAGCACCACCAGGACCTGACCCTGC |
| | | TGAAAGCTCTCGTGCGGCAGCAGCTGCCTGAGAAGTACAAAGAGATTTTCTTCGACCAGAGCAAG |
| | | AACGGCTACGCCGGCTACATTGACGGCGGAGCCAGCCAGGAAGAGTTCTACAAGTTCATCAAGC |
| | | CCATCCTGGAAAAGATGGACGGCACCGAGGAACTGCTCGTGAAGCTGAACAGAGAGGACCTGCT |
| | | GCGGAAGCAGCGGACCTTCGACAACGGCAGCATCCCCCACCAGATCCACCTGGGAGAGCTGCAC |
| | | GCCATTCTGCGGCGGCAGGAAGATTTTTACCCATTCCTGAAGGACAACCGGGAAAAGATCGAGA |
| | | AGATCCTGACCTTTCGCATCCCCTACTACGTGGGCCCTCTGGCCAGGGGAAACAGCAGATTCGCC |
| | | TGGATGACCAGAAAGAGCGAGGAAACCATCACCCCCTGGAACTTCGAGGAAGTTGTGGACAAGG |
| | | GCGCTTCCGCCCAGAGCTTCATCGAGCGGATGACCAACTTCGATAAGAACCTGCCCAACGAGAAG |
| | | GTGCTGCCCAAGCACAGCCTGCTGTACGAGTACTTCACCGTGTATAACGAGCTGACAAAGTGAA |
| | | ATACGTGACCGAGGAATGAAGAAGCCCGGCTTCTGCGAGCGGCCACTGCAGCAAAAGGCCATCGTG |
| | | GACCTGCTGTTCAAGACCAACCGGAAGGTGACCGTGAAGCAGCTGAAGGAAGATTACAAGA |
| | | AAATCGAGTGCTTCGACTCCGTGGAAATCTCCGGCGTGGAAGATCGGTTCAACGCCTCCCTGGGC |
| | | ACATACCACGATCTGCTGAAAATTATCAAGGACAAGGACTTCCTGGACAATGAGGAAAACGAGG |
| | | ACATTCTGGAAGATATCGTCCTGACACTGTTTGAGGACAGAGAGATGATCGAGGAACGG |
| | | CTGAAAACCTATGCCCAATCTGCCGGCAGCCCCGCCATTAAGAAGGGCATCCTGCAGACAGTGAAG |
| | | CCGGCTGGGGACAGGCTGAGCCGGAAAATGATCAACGGCATCCGGGACAAGCAGTCCGGCAAGAC |
| | | AATCCTGGATTTCCTGAAGTCCGACGGCTTCGCCAACAGAAACTTCATGCAGCTGATCCACGACG |
| | | ACAGCCTGACCTTTAAAGAGGACATCCAGAAAGCCCAGGTGTCCGGCCAGGGCGATAGCCTGCA |
| | | CGAGCACATTGCCAATCTGGCCGGCAGCCCCGCCATTAAGAAGGGCATCCTGCAGACAGTGAAG |
| | | GTGGTGGACGAGCTCGTGAAAGTGATGGGCCGGCACAAGCCCGAGAACATCGTCATCGAAATGG |
| | | CCAGAGAGAACCAGACCACCCAGAAGGACAGCAGCCAGATCCTGAAAGAACACCCCGTGGAAAACACCCCAGCT |
| | | AAGAGCGAAGCATCAAAGACCTGGGCAGCCAGATCCTGAAAGAACATCCTGAAGAATGGGATCG |
| | | GCAGAACGAGAAGCTGTACCTGTACTACCTGCAGAATGGCCGCGATATGTACGTGGACCAGGAA |
| | | CTGGACATCAACCGGCTGTCCGACTACGATGTGGACCACATCGTGCCCCAGAGCTTTCTGAAGGA |
| | | CGACTCCATCGACAACAAGGTCGTGACCCGGAGCGACAAGAACAGGGGCAAGAGCGACAACGTG |
| | | CCCTCCGAAGAAGTCGTCAAAAAATGAAGAATACTGGCGGCAGCTGCTGAGCGCAAAGCTGGATAA |
| | | TTACCCAGAAAGTTCGACAATCTGACCAAGGCCGAGAGGGGCGGCTGAGCGAGCTGGATAAAGCG |
| | | GGCCGGCTTCATCAAGAGACAGCTGGTGGAAACCCGGCAGATCACAAAGCACGTGGCACAAGTGA |
| | | CTGGACTTCCCCGATGAACCTAAGTACGAGCAGATTGACACAAGCGGAAGACATCCGGAAGTGA |
| | | TCACCCGTAAAGTCAAGTGGTGTCCAAGAAAACTAAAGCCGCGTGGATCGGCAAGATATCAA |
| | | ATCAACAACTACCACCACGCCCACGACGCCTACCTGAACGCCGTGGTCGGAACCGCCCTGATCAA |
| | | AAAGTACCCTAAGCTGGAAAGCGAGTCTGTATCGGCAAGGCTACGAAGGTGTACAGGTTCGGAAG |
| | | ATGATCGCCCAAGAGCGCAGGAAATCGGCAAGGCTACCGCCAAGTACTTCTTCTACAAGCAACAT |
| | | CATGAACTTTTTCAAGACCGAGATTACCCTGGCCAACGGCGAGATCCGGAAGCGCCCTCTGATCG |
| | | AGACAAACGGCGAAACCGGGGAGATCGTGTGGATAAGGGCCGGGATTTGCCACCGTGCGAA |
| | | AGTGCTGAGCATGCCCCAAGTCGAATATCGAAAAAGACCGAGGTCGAGACAGGCGGCTTCAGC |

TABLE 35-continued

| Constructs | Maps | Sequences |
|---|---|---|
| | | AAAGAGTCTATCCTGCCCAAGAGGAACAGCGATAAGCTGATCGCCAGAAAGAAGGACTGGGACC |
| | | CTAAGAAGTACGGCGGCTTCGACAGCCCACCGTGGCCTATTCTGTCTGGTGGTGCCAAAGTG |
| | | GAAAAGGGCAAGTCCAAGAAACTGAAAGAGTGTGAAAGAGCTGCTGGGGATCACCATCATGGAAA |
| | | GAAGCAGCTTCGAGAAGAATCCCATCGACTTTCTGGAAGCCAAGGGCTACAAAGAAGTGAAAAA |
| | | GGACCTGATCATCAAGCTGCCTAAGTACTCCCTGTTCGAGCTGGAAAACGGCCGAAGAGAATGC |
| | | TGGCCCTCTGCCGGCGAACTGCAGAAGGGAAACGAACTGGCCCTGCCCTCCAAATATGTGAACTTC |
| | | CTGTACCTGGCCAGCCACTATGAGAAGCTGAAGGGCTCCCCCGAGGATAATGAGCAGAAACAGC |
| | | TGTTTGTGGAACAGCACAAGCACTACCTGGACGAGGTCATCGAGCAGATCAGCGAGTTCTCCAAG |
| | | AGAGTGATCCTGGCCGACGCTAATCTGGACAAAGTGCTGTCCGCCTACAACAAGCACCGGGATAA |
| | | GCCCATCAGAGAGCAGGCCGAGAATATCATCCACCTGTTTACCCTGACCAATCTGGGAGCCCCTG |
| | | CCGCCTTCAAGTACTTTGACACCACCATCGACCGGAAGAGGTACACCAGCACCAAAGAGGTGCTG |
| | | GACGCCACCCCTGATCCACCAGAGCATCACCGGCCTGTACGAGACACGGATCACCCTGTCTCAGCT |
| | | GGGAGGCCGACGGTGGCGGAAGCGCCCAAAGAAGAAGCGGAAGGTCGGAGGCGGAAGCGGAGGAAGCGGAGGAGGAGGTAG |
| | | cagcgtgatcaccatccagtgcagactggtggccagagcaccaaggaggccgaagaagctgggagcaagcatcctgagacgtgtgggagctgatggccgacaagagcctgataacgagct |
| | | gctggccaagtgggaaagcaccccgagtttgagacatggccagaatcccccaagctgcgaaaaccctggtcaacagttcaagaccca |
| | | agagagattcgccgaccagccctggcagattctacacctctgccattgctctgtggactacgtgtacaagatggttcgcctgcagaagcggcggaagagac |
| | | agatcgaggcaaagagaagatgctgaccatccagaagttcgaggccctgaagtccagtgcacgagtccaagtaccagacagagccagagcgagagccaac |
| | | gagatccgacacagttcaccccctgagcgagcagaacaagaccccgaggacaagaagagccaagagaagtccaccaagtccgagaagtcagcctgtt |
| | | ccagatcctgctgaacacctgaacacctacgagacagaccagaatcctgacagtgcgagcgccattgtgctacctgaagaacaactgcctgagcagatcaggcagagccagagtgacgag |
| | | gacagcgaggaattcaccaagacgccggaagagatgacgccgagcgaagatcagtcgagcaggatcgagcgccaaggccagagcagagatctgac |
| | | cggcgagaatgctcaagacctgaatctgggcctacgagagcagatgccccaagctgccccagaacgagaatgaagccaaagccaggactgttcgtgcgttcaacggcctgggcaag |
| | | gccgacgtgccattcctggcctgccgacaagcggcatcgcactacttcaagcggttctcgaggacagagccctggaaggcagagtcagtacagcagctc |
| | | ctgacctgcagatctctagctgcgacaaggggatcttggggtagactgcttggagccctgcgaggaaaaagcgagcgagcccctgaccctgaccacc |
| | | cctgttcacccgcggagtggtagacctgcttggagcccgcgcagttgtcgtggaccaccagctgaacctgaacctgaccctgaccacctgaccccgacacc |
| | | agaatgtggacctcgggagaaccccagcagtcgtggacgagaaaaggcaaccaagatcaacgacgagaaacgacaacaagccaagaaaggccaaagccgaccgacctgaaacg |
| | | accagcagcaggcctcatcaccagacagcagacactggacTAA |

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (1332 sequences)

SEQ ID NO: 1 - RNA, 144 nt, Scytonema hoffmanni
aaauacagucuugcuuucugacccugguagcugcucacccugaugcugcugucaauagacaggauaggugcgcucccagcaauaagggcgcggauguacugcuguaguggcuacugaaucacccccgaucaagggggaacccuc

SEQ ID NO: 2 - RNA, 115 nt, Scytonema hoffmanni
aaauacagucuugcuuucugacccugguagcugcucacccugaugcugcugucaauagacaggauaggugcgcucccagcaauaagggcgcggauguacugcuguaguggcuacu

SEQ ID NO: 3 - RNA, 89 nt, Scytonema hoffmanni
agacaggauaggugcgcucccagcaauaagggcgcggauguacugcuguaguggcuacugaaucacccccgaucaagggggaacccucc

SEQ ID NO: 4 - RNA, 81 nt, Scytonema hoffmanni
aggugcgcucccagcaauaagggcgcggauguacugcuguaguggcuacugaaucacccccgaucaagggggaacccuccc

SEQ ID NO: 5 - DNA, 154 bp, Escherichia coli
  misc_feature (60)..(65): n is a, c, g, or t
agaagatcatcttattaatatacgtagtatctacgatacgtagtatctacgatacgtagnnnnnngagaagtcatttaataaggccactgttaaacgtagatatatctacgcgtagatatatctacgatacgtagcggccgacgcgctgggcta

SEQ ID NO: 6 - DNA, 154 bp, Escherichia coli
  misc_feature (60)..(65): n is a, c, g, or t
tcttctagtagaataattatatgcatcatagatgctatgcatcatagatgctatgcatcnnnnnnctcttcagtaaattattccggtgacaatttgcatctatatagatgcgcatctatatagatgctatgcatcgccggctgcgcgacccgat

SEQ ID NO: 7 - DNA, 160 bp, Artificial Sequence
  Synthetic Oligonucleotide
gaggttgagaagtcatttaataaggccactgttaaaaagcttggcgtacgcagcgatttccaacagcttgtgtacagtgacaaattatctgtcgtcggtgacagattaatgtcattgtgactatttaattgtcgtcgtgacccatcagcgttgcttaatt

SEQ ID NO: 8 - DNA, 161 bp, Artificial Sequence
  Synthetic Oligonucleotide
gaggttgagaagtcatttaataaggccactgttaaaaagcttggcgtacgcagcgatttccaacagcttgtgtacagtgacaaattatctgtcgtcggtgacaagattaatgtcattgtgactatttaattgtcgtcgtgacccatcagcgttgcttaatt

SEQ ID NO: 9 - DNA, 177 bp, Artificial Sequence
  Synthetic Oligonucleotide
ttgtcacaatcacggacaacgacatctattttgtcactgcaaagaggttatgctaaaactgccaaagcgctataatctatactgtataaggattttactgatgacaataatttgtcacaacgacatataattagtcactgtacagcttgaggcgggacagaaaagtcaatgagtatt

SEQ ID NO: 10 - DNA, 177 bp, Artificial Sequence; identical to SEQ ID NO: 9
  Synthetic Oligonucleotide

SEQ ID NO: 11 - RNA, 225 nt, Escherichia coli
auauuaauagcgccgcaauucauccuccuugcagccucugaauguucuuaaaugaggguuaguuugacuguauaaauacagucuugcuuucugacccugguagcugcucacccucaugcugcugucaauagacaauugcgcucccagcaauaagggcgcgcauguacugcuguacuggcuacugaaucacccccgaucaaggggcaacccuaaauggguugaaag

SEQ ID NO: 12 - RNA, 11 nt, Artificial Sequence
  Synthetic Oligonucleotide
gggaacccucc

SEQ ID NO: 13 - RNA, 14 nt, Artificial Sequence
  Synthetic Oligonucleotide
agguggguugaaag

SEQ ID NO: 14 - RNA, 20 nt, Artificial Sequence
  Synthetic Oligonucleotide
aacccuccaaaagguggguu

SEQ ID NO: 15 - RNA, 15 nt, Artificial Sequence
  Synthetic Oligonucleotide
aacccuaaauggguu

SEQ ID NO: 16 - DNA, 107 bp, Artificial Sequence
  Synthetic Oligonucleotide
ggttgagaagtcatttaataaggccactgttaaacgtagatatatctacgcgtagatatatctacgatactgtacagtgacaaattagtcactctacagatacgtag

SEQ ID NO: 17 - DNA, 107 bp, Artificial Sequence
  Synthetic Oligonucleotide
ggttgagaagtcatttaataaggccactgttaaacgtagatatatctacgcgtagatatatctacgattgtacagtgacaaattagtcactgtacaacgatacgtag

SEQ ID NO: 18 - DNA, 107 bp, Artificial Sequence
  Synthetic Oligonucleotide
ggttgagaagtcatttaataaggccactgttaaacgtagatatatctacgcgtagatatatctacgtgtacagtgacaaattagtcactgtacactacgatacgtag

SEQ ID NO: 19 - DNA, 75 bp, Artificial Sequence
  Synthetic Oligonucleotide
ggttgagaagtcatttaataaggccactgttaaacgtagatatatctacgcgtagattatatctacgatacgtag

SEQ ID NO: 20 - DNA, 64 bp, Artificial Sequence
  Synthetic Oligonucleotide
gatcctgcttgcatgtagtcagttatcaggtcagtcgttaccggtcatgatcacgctatagcga

SEQ ID NO: 21 - DNA, 140 bp, Artificial Sequence
  Synthetic Oligonucleotide
gatcctgcttgcatgtagtcagttatcaggtcagtcgttaccaaaactaacgccttaaagcccctagcttccctagctttagctatggggagtatgtcaaacggcgatgctagaagacggtcatgatcacgctatagcga

SEQ ID NO: 22 - DNA, 140 bp, Artificial Sequence; identical to SEQ ID NO: 21
  Synthetic Oligonucleotide

SEQ ID NO: 23 - DNA, 140 bp, Artificial Sequence; identical to SEQ ID NO: 21
  Synthetic Oligonucleotide

SEQ ID NO: 24 - DNA, 140 bp, Artificial Sequence; identical to SEQ ID NO: 21
  Synthetic Oligonucleotide

SEQ ID NO: 25 - DNA, 140 bp, Artificial Sequence; identical to SEQ ID NO: 21
  Synthetic Oligonucleotide

SEQ ID NO: 26 - DNA, 140 bp, Artificial Sequence; identical to SEQ ID NO: 21
  Synthetic Oligonucleotide

SEQ ID NO: 27 - DNA, 140 bp, Artificial Sequence; identical to SEQ ID NO: 21
  Synthetic Oligonucleotide

SEQ ID NO: 28 - DNA, 140 bp, Artificial Sequence; identical to SEQ ID NO: 21
  Synthetic Oligonucleotide

SEQ ID NO: 29 - DNA, 140 bp, Artificial Sequence; identical to SEQ ID NO: 21
  Synthetic Oligonucleotide

SEQ ID NO: 30 - DNA, 140 bp, Artificial Sequence; identical to SEQ ID NO: 21
  Synthetic Oligonucleotide

SEQ ID NO: 31 - DNA, 37 bp, Scytonema hofmanni
ctttcaacccacctagtacctggaaggttgttgccac

SEQ ID NO: 32 - DNA, 36 bp, Anabaena cylindrica
ctttcaaccacccctagtcgggatggtagttgaaac

SEQ ID NO: 33 - DNA, 107 bp, Escherichia coli
ggttgagaagtcatttaataaggccactgttaaacgtagatatatctacgcgtagatatatctacgatatgtacagtgacaaattagtcactgtacacgatacgtag

SEQ ID NO: 34 - DNA, 107 bp, Escherichia coli; identical to SEQ ID NO: 17

SEQ ID NO: 35 - DNA, 107 bp, Escherichia coli; identical to SEQ ID NO: 18

SEQ ID NO: 36 - DNA, 107 bp, Escherichia coli
ggttgagaagtcatttaataaggccactgttaaacgtagatatatctacgcgtagatatatctactgtacagtgacaaattagtcactgtacatctacgatacgtag

SEQ ID NO: 37 - DNA, 73 bp, Escherichia coli
ggttgagaagtcatttaataaggccactgttaaacgtagatatatctacgcgtagatatatctacgatagtag

SEQ ID NO: 38 - DNA, 235 bp, Artificial Sequence
  Synthetic Oligonucleotide
ttagacatctccacaaaaggcgtagtgtacagtgacaaattatctgtcgtcggtgacagattaatgtcattgtgactatttaattgtcgtcgtgacccatcagcgttgcttaattaattgatgacaaattaaatgtcatcaatataatatgctctgcaattattatacaaagcaattaaaacaagcggataaaaggacttgctttcaacccacccctaagtttaatagttactga

SEQ ID NO: 39 - DNA, 237 bp, Artificial Sequence
  Synthetic Oligonucleotide
gcgacagtcaatttgtcattatgaaaatacacaaaagctttttcctatcttgcaaagcgacagctaatttgtcacaatcacggacaacgacatctattttgtcactgcaaagaggttatgctaaaactgccaaagcgctataatctatactgtataaggattttactgatgacaataatttgtcacaacgacatataattagtcactgtacacgtagagacgtagcaatgctacctc

SEQ ID NO: 40 - DNA, 25 bp, Artificial Sequence
  Synthetic Oligonucleotide
tgtmcagtgacaaaytatwtgtcgt

SEQ ID NO: 41 - DNA, 18 bp, Artificial Sequence
  Synthetic Oligonucleotide
gtgacagaytaatgtcat

SEQ ID NO: 42 - DNA, 18 bp, Artificial Sequence
  Synthetic Oligonucleotide
atgacaaattaaatgtca

SEQ ID NO: 43 - DNA, 18 bp, Artificial Sequence
  Synthetic Oligonucleotide
atgacaaattgactgtcg

SEQ ID NO: 44 - DNA, 18 bp, Artificial Sequence
  Synthetic Oligonucleotide
gtgacaaattagctgtcg

SEQ ID NO: 45 - DNA, 18 bp, Artificial Sequence
  Synthetic Oligonucleotide
gtgacaaattattgtcat

SEQ ID NO: 46 - DNA, 25 bp, Artificial Sequence
  Synthetic Oligonucleotide
tgtacagtgacaaattatctgtcgt

SEQ ID NO: 47 - DNA, 25 bp, Artificial Sequence
  Synthetic Oligonucleotide
tttgcagtgacaaaatagatgtcgt

SEQ ID NO: 48 - DNA, 25 bp, Artificial Sequence
  Synthetic Oligonucleotide
tgtacagtgactaattatatgtcgt

SEQ ID NO: 49 - DNA, 23 bp, Artificial Sequence
  Synthetic Oligonucleotide
gtacagtttamaactattttgtc

SEQ ID NO: 50 - DNA, 74 bp, Artificial Sequence
  Synthetic Oligonucleotide
gggagtcttcttacttacttacttacttacttacttacttacttacttacttacttacggggggcaccaaaact

SEQ ID NO: 51 - DNA, 74 bp, Artificial Sequence; identical to SEQ ID NO: 50
  Synthetic Oligonucleotide

SEQ ID NO: 52 - DNA, 74 bp, Artificial Sequence; identical to SEQ ID NO: 50
  Synthetic Oligonucleotide

SEQ ID NO: 53 - DNA, 74 bp, Artificial Sequence; identical to SEQ ID NO: 50
  Synthetic Oligonucleotide

SEQ ID NO: 54 - DNA, 60 bp, Artificial Sequence
  Synthetic Oligonucleotide
gagtcttcttacttacttacttacttacttacttacttacttacttacttacttacgggg

SEQ ID NO: 55 - DNA, 58 bp, Artificial Sequence
  Synthetic Oligonucleotide
ctcaatgaccgggactaaagttacttactttacttacttacttacggggggaggcgaa

SEQ ID NO: 56 - DNA, 34 bp, Scytonema hofmanni
aggtgggttgaaagggctattgccttatctaatt

SEQ ID NO: 57 - RNA, 11 nt, Artificial Sequence
  Synthetic Oligonucleotide
gggaacccucc

SEQ ID NO: 58 - RNA, 14 nt, Artificial Sequence
  Synthetic Oligonucleotide
agguggguugaaag

SEQ ID NO: 59 - RNA, 20 nt, Artificial Sequence
  Synthetic Oligonucleotide
aacccuccaaaagguggguu

SEQ ID NO: 60 - RNA, 15 nt, Artificial Sequence
  Synthetic Oligonucleotide
aacccuaaauggguu

SEQ ID NO: 61 - DNA, 107 bp, Escherichia coli
ggttgagaagtcatttaataaggccactgttaaacgtagatatatctacgcgtagatatatctacgatactgtacagtgacaaattagtcactgtacagatacgtag

SEQ ID NO: 62 - DNA, 107 bp, Escherichia coli; identical to SEQ ID NO: 17

SEQ ID NO: 63 - DNA, 107 bp, Escherichia coli; identical to SEQ ID NO: 18

SEQ ID NO: 64 - DNA, 74 bp, Escherichia coli
ggttgagaagtcatttaataaggccactgttaaacgtagatatatctacgcgtagatatatctacgatacgtag

SEQ ID NO: 65 - DNA, 81 bp, Artificial Sequence
  Synthetic Oligonucleotide
gatcctgcttgcatgtagtcagttatcaggtcagtcgttacacggcgatgctagaagacggtcatgatcacgctatagcga

SEQ ID NO: 66 - DNA, 140 bp, Artificial Sequence; identical to SEQ ID NO: 21
  Synthetic Oligonucleotide

SEQ ID NO: 67 - DNA, 140 bp, Artificial Sequence; identical to SEQ ID NO: 21
  Synthetic Oligonucleotide

SEQ ID NO: 68 - DNA, 140 bp, Artificial Sequence; identical to SEQ ID NO: 21
  Synthetic Oligonucleotide

SEQ ID NO: 69 - DNA, 140 bp, Artificial Sequence; identical to SEQ ID NO: 21
  Synthetic Oligonucleotide

SEQ ID NO: 70 - DNA, 140 bp, Artificial Sequence; identical to SEQ ID NO: 21
  Synthetic Oligonucleotide

SEQ ID NO: 71 - DNA, 141 bp, Artificial Sequence
  Synthetic Oligonucleotide
gatcctgcttgcatgtagtcagttatcaggtcagtccttaccaaaactaacgccttaaagcccctagcttccctagctttagctatgggggagtatgtcaaacggcgatgctagaagacggtcatgatcacgctatagcga

SEQ ID NO: 72 - DNA, 140 bp, Artificial Sequence; identical to SEQ ID NO: 21
  Synthetic Oligonucleotide

SEQ ID NO: 73 - DNA, 140 bp, Artificial Sequence; identical to SEQ ID NO: 21
  Synthetic Oligonucleotide

SEQ ID NO: 74 - DNA, 140 bp, Artificial Sequence; identical to SEQ ID NO: 21
  Synthetic Oligonucleotide

SEQ ID NO: 75 - DNA, 140 bp, Artificial Sequence; identical to SEQ ID NO: 21
  Synthetic Oligonucleotide

SEQ ID NO: 76 - DNA, 107 bp, Escherichia coli; identical to SEQ ID NO: 33

SEQ ID NO: 77 - DNA, 107 bp, Escherichia coli; identical to SEQ ID NO: 17

SEQ ID NO: 78 - DNA, 107 bp, Escherichia coli; identical to SEQ ID NO: 18

SEQ ID NO: 79 - DNA, 107 bp, Escherichia coli; identical to SEQ ID NO: 36

SEQ ID NO: 80 - DNA, 73 bp, Escherichia coli; identical to SEQ ID NO: 37

SEQ ID NO: 81 - DNA, 235 bp, Artificial Sequence; identical to SEQ ID NO: 38
  Synthetic Oligonucleotide

SEQ ID NO: 82 - DNA, 237 bp, Artificial Sequence; identical to SEQ ID NO: 39
  Synthetic Oligonucleotide

SEQ ID NO: 83 - DNA, 25 bp, Artificial Sequence
  Synthetic Oligonucleotide
tgtmcagtgacaaaytatwtgtcgt

SEQ ID NO: 84 - DNA, 18 bp, Artificial Sequence
  Synthetic Oligonucleotide
gtgacagaytaatgtcat

SEQ ID NO: 85 - DNA, 18 bp, Artificial Sequence
  Synthetic Oligonucleotide
atgacaaattaaatgtca

SEQ ID NO: 86 - DNA, 18 bp, Artificial Sequence
  Synthetic Oligonucleotide
atgacaaattgactgtcg

SEQ ID NO: 87 - DNA, 18 bp, Artificial Sequence
  Synthetic Oligonucleotide
gtgacaaattagctgtcg

SEQ ID NO: 88 - DNA, 18 bp, Artificial Sequence
  Synthetic Oligonucleotide
gtgacaaattattgtcat

SEQ ID NO: 89 - DNA, 25 bp, Artificial Sequence
  Synthetic Oligonucleotide
tgtacagtgacaaattatctgtcgt

SEQ ID NO: 90 - DNA, 25 bp, Artificial Sequence
  Synthetic Oligonucleotide
tttgcagtgacaaaatagatgtcgt

SEQ ID NO: 91 - DNA, 25 bp, Artificial Sequence
  Synthetic Oligonucleotide
tgtacagtgactaattatatgtcgt

SEQ ID NO: 92 - DNA, 23 bp, Artificial Sequence
  Synthetic Oligonucleotide
gtacagtttamaactattttgtc

SEQ ID NO: 93 - DNA, 27 bp, Artificial Sequence
  Synthetic Oligonucleotide
  misc_feature (1)..(1): n is a, c, g, or t
  misc_feature (4)..(4): n is a, c, g, or t
ngtnactatagactatccgggcaatgt

SEQ ID NO: 94 - DNA, 27 bp, Artificial Sequence
  Synthetic Oligonucleotide
  misc_feature (1)..(1): n is a, c, g, or t
  misc_feature (4)..(4): n is a, c, g, or t
ngtnactatagagaatccgggttatgt

SEQ ID NO: 95 - DNA, 65 bp, Artificial Sequence
  Synthetic Oligonucleotide
  misc_feature (41)..(44): n is a, c, g, or t
  misc_feature (48)..(51): n is a, c, g, or t
ggtggctacygaatcaccycckwsswmggrggaayccwccnnnnaaannnnrggygggttgaaag

SEQ ID NO: 96 - DNA, 47 bp, Artificial Sequence
  Synthetic Oligonucleotide
gttggctaccaaacaagcccgagcaaaaatgttgggtgggttgaaag

SEQ ID NO: 97 - DNA, 57 bp, Artificial Sequence
  Synthetic Oligonucleotide
ggcagctaccaaacagccccgagcaagggggccaaaaggctctcaaggggcggaaag

SEQ ID NO: 98 - DNA, 41 bp, Artificial Sequence
  Synthetic Oligonucleotide
ggtggctaccgaactaccaccaaaaggtggtgggttgaaag

SEQ ID NO: 99 - DNA, 53 bp, Artificial Sequence
  Synthetic Oligonucleotide
agtggttatccaatcacctccgatcaaggaggaatcccaaaagggattgaaag

SEQ ID NO: 100 - DNA, 57 bp, Artificial Sequence
  Synthetic Oligonucleotide
agttgttatcaaatcacctccgaccaaggaggaatctctaaaaatagggattgaaag

SEQ ID NO: 101 - DNA, 60 bp, Artificial Sequence
  Synthetic Oligonucleotide
gatggttatcaagttcacctccgagcaaggaggaatccacccaaaagggcgggttgaaag

SEQ ID NO: 102 - DNA, 60 bp, Artificial Sequence; identical to SEQ ID NO: 101
  Synthetic Oligonucleotide

SEQ ID NO: 103 - DNA, 57 bp, Artificial Sequence
  Synthetic Oligonucleotide
ggtggctccgaactcgtccccttcgggggagccctcccaaaagggatgggttgaaag

SEQ ID NO: 104 - DNA, 48 bp, Artificial Sequence
  Synthetic Oligonucleotide
ggtggctaccgaactaccaccccctaaaaataggtggtgggttgaaag

SEQ ID NO: 105 - DNA, 41 bp, Artificial Sequence; identical to SEQ ID NO: 98
  Synthetic Oligonucleotide

SEQ ID NO: 106 - DNA, 65 bp, Artificial Sequence
  Synthetic Oligonucleotide
gctggttagccaatctcacctccgagcaaggaggaatccacccctaaaaagggggcgattgaaag

SEQ ID NO: 107 - DNA, 65 bp, Artificial Sequence; identical to SEQ ID NO: 106
  Synthetic Oligonucleotide

SEQ ID NO: 108 - DNA, 64 bp, Artificial Sequence
  Synthetic Oligonucleotide
gatggctactgaatcacctccgaccaaggaggaatccacttataaaaatgaaatggattgaaag

SEQ ID NO: 109 - DNA, 64 bp, Artificial Sequence
  Synthetic Oligonucleotide
agttgtcactgaatcacctccgagcaaggaggaatccatccttaaaaaagggatgggttgaaag

SEQ ID NO: 110 - DNA, 62 bp, Artificial Sequence
  Synthetic Oligonucleotide
ggtagttaccgaatcgcccctgatcaagggggaaccctccataaaaatgggtgggttgaaag

SEQ ID NO: 111 - DNA, 66 bp, Artificial Sequence
  Synthetic Oligonucleotide
gatggcactgaaccacctccgagcaaggaggaatctatccttgaaaaatctggggttgattgaaag

SEQ ID NO: 112 - DNA, 65 bp, Artificial Sequence
  Synthetic Oligonucleotide
gatggctaccgaatcacccccgaccaagggggaatccaccccaaaaaattgggatggattgaaag

SEQ ID NO: 113 - DNA, 66 bp, Artificial Sequence
  Synthetic Oligonucleotide
gatcgctaccgaatcacctccgagcaaggaggagtctatcctcataaaaatgggtatggttgaaag

SEQ ID NO: 114 - DNA, 66 bp, Artificial Sequence; identical to SEQ ID NO: 113
  Synthetic Oligonucleotide

SEQ ID NO: 115 - DNA, 59 bp, Artificial Sequence
  Synthetic Oligonucleotide
gatggctactgaatcacctccgagcaagggggaatccacccaaaagggtgggttgaaag

SEQ ID NO: 116 - DNA, 60 bp, Artificial Sequence
  Synthetic Oligonucleotide
ggtggctactgaatcacccccttcgtcgggggaaccctcccaaaaggggtgggttgaaag

SEQ ID NO: 117 - DNA, 94 bp, Artificial Sequence
  Synthetic Oligonucleotide
tttctaaagcggtttttactgcttcgtgaaatatatcttttgcagattttctaaagcggtttttactgcttcgtgaaatatatcttttgcagat

SEQ ID NO: 118 - DNA, 94 bp, Artificial Sequence
  Synthetic Oligonucleotide
tatcatcaatagcaaatctttgtcttaaggattcattagtvatttgctatcatcaatagcaaatctttgtcttaaggattcattagtcatttgc

SEQ ID NO: 119 - DNA, 94 bp, Artificial Sequence
  Synthetic Oligonucleotide
gaacaaaattctcaaaataatcttaaacctcaacaatatcaacgcctgaacaaaattctcaaaataatcttaaacctcaacaatatcaacgcct

SEQ ID NO: 120 - DNA, 47 bp, Artificial Sequence
  Synthetic Oligonucleotide
gaacaaaattctcaaaataatcttaaacctcaacaatatcaacgcct

SEQ ID NO: 121 - DNA, 105 bp, Artificial Sequence
  Synthetic Oligonucleotide
  misc_feature (84)..(84): n is a, c, g, or t
agtatctacgatacgtagwkrgtrgagaagtcatttaataaggccactgttaaacgtagatatatctacgcgtagatatatctntgtagaataactaattatttg

SEQ ID NO: 122 - DNA, 105 bp, Artificial Sequence
  Synthetic Oligonucleotide
  misc_feature (19)..(24): n is a, c, g, or t
agtatctacgatacgtagnnnnnngagaagtcatttaataaggccactgttaaacgtagatatatctacgcgtagatatatctatgtcgaataactaattatttg

SEQ ID NO: 123 - DNA, 105 bp, Artificial Sequence
  Synthetic Oligonucleotide
agtatctacgatacgtagtcagtggagaagtcatttaataaggccactgttaaacgtagatatatctacgcgtagatatatctatgtcgaataactaattatttg

SEQ ID NO: 124 - DNA, 105 bp, Artificial Sequence
  Synthetic Oligonucleotide
agtatctacgatacgtagatggttgagaagtcatttaataaggccactgttaaacgtagatatatctacgcgtagatatatctatgtcgaataactaattatttg

SEQ ID NO: 125 - DNA, 105 bp, Artificial Sequence; identical to SEQ ID NO: 124
  Synthetic Oligonucleotide

SEQ ID NO: 126 - DNA, 105 bp, Artificial Sequence
  Synthetic Oligonucleotide
agtatctacgatacgtagtggggagagaagtcatttaataaggccactgttaaacgtagatatatctacgcgtagatatatctatgtcgaataactaattatttg

SEQ ID NO: 127 - DNA, 105 bp, Artificial Sequence
  Synthetic Oligonucleotide
agtatctacgatacgtagggagtagagaagtcatttaataaggccactgttaaacgtagatatatctacgcgtagatatatctatgtcgaataactaattatttg

SEQ ID NO: 128 - DNA, 105 bp, Artificial Sequence
  Synthetic Oligonucleotide
agtatctacgatacgtagaacgtagagaagtcatttaataaggccactgttaaacgtagatatatctacgcgtagatatatctatgtcgaataactaattatttg

SEQ ID NO: 129 - DNA, 105 bp, Artificial Sequence
  Synthetic Oligonucleotide
agtatctacgatacgtagcacgttgagaagtcatttaataaggccactgttaaacgtagatatatctacgcgtagatatatctatgtcgaataactaattatttg

SEQ ID NO: 130 - DNA, 104 bp, Artificial Sequence
  Synthetic Oligonucleotide
agtatctacgatacgtagatggtagagaagtcatttaataaggccactgttaaacgtagattatctacgcgtagatatatctatgtcgaataactaattatttg

SEQ ID NO: 131 - DNA, 105 bp, Artificial Sequence; identical to SEQ ID NO: 127
  Synthetic Oligonucleotide

SEQ ID NO: 132 - DNA, 105 bp, Artificial Sequence
  Synthetic Oligonucleotide
agtatctacgatacgtagcaggtggagaagtcatttaataaggccactgttaaacgtagatatatctacgcgtagatatatctatgtcgaataactaattatttg

SEQ ID NO: 133 - DNA, 105 bp, Artificial Sequence; identical to SEQ ID NO: 129
  Synthetic Oligonucleotide

SEQ ID NO: 134 - DNA, 105 bp, Artificial Sequence
  Synthetic Oligonucleotide
agtatctacgatacgtagatagtggagaagtcatttaataaggccactgttaaacgtagatatatctacgcgtagatatatctatgtcgaataactaattatttg

SEQ ID NO: 135 - DNA, 105 bp, Artificial Sequence; identical to SEQ ID NO: 134
  Synthetic Oligonucleotide

SEQ ID NO: 136 - DNA, 105 bp, Artificial Sequence; identical to SEQ ID NO: 127
  Synthetic Oligonucleotide

SEQ ID NO: 137 - DNA, 105 bp, Artificial Sequence
  Synthetic Oligonucleotide
agtatctacgatacgtaggtggtagagaagtcatttaataaggccactgttaaacgtagatatatctacgcgtagatatatctatgtcgaataactaattatttg

SEQ ID NO: 138 - DNA, 105 bp, Artificial Sequence
  Synthetic Oligonucleotide
agtatctacgatacgtagggggcagagaagtcatttaataaggccactgttaaacgtagatatatctacgcgtagatatatctatgtcgaataactaattatttg

SEQ ID NO: 139 - DNA, 105 bp, Artificial Sequence
  Synthetic Oligonucleotide
agtatctacgatacgtagttagtagagaagtcatttaataaggccactgttaaacgtagatatatctacgcgtagatatatctatgtcgaataactaattatttg

SEQ ID NO: 140 - DNA, 105 bp, Artificial Sequence
  Synthetic Oligonucleotide
agtatctacgatacgtagtaagtagagaagtcatttaataaggccactgttaaacgtagatatatctacgcgtagatatatctatgtcgaataactaattatttg

SEQ ID NO: 141 - DNA, 105 bp, Artificial Sequence; identical to SEQ ID NO: 129
  Synthetic Oligonucleotide

SEQ ID NO: 142 - DNA, 105 bp, Artificial Sequence
  Synthetic Oligonucleotide
agtatctacgatacgtagggggtggagaagtcatttaataaggccactgttaaacgtagatatatctacgcgtagatatatctatgtcgaataactaattatttg

SEQ ID NO: 143 - DNA, 105 bp, Artificial Sequence; identical to SEQ ID NO: 124
  Synthetic Oligonucleotide

SEQ ID NO: 144 - DNA, 105 bp, Artificial Sequence
  Synthetic Oligonucleotide
agtatctacgatacgtagtgcgtagagaagtcatttaataaggccactgttaaacgtagatatatctacgcgtagatatatctatgtcgaataactaattatttg

SEQ ID NO: 145 - DNA, 75 bp, Artificial Sequence
  Synthetic Oligonucleotide
gtgttccttataataattggttatatgagaggcagttccacgtagtgtaatagaactgtcgaataactaattatt

SEQ ID NO: 146 - DNA, 70 bp, Artificial Sequence
  Synthetic Oligonucleotide
ttccttataataattggttatatgagaggcagttccacgtagtgtaatagatgtcgaataactaattatt

SEQ ID NO: 147 - DNA, 70 bp, Artificial Sequence; identical to SEQ ID NO: 146
  Synthetic Oligonucleotide

SEQ ID NO: 148 - DNA, 74 bp, Artificial Sequence
  Synthetic Oligonucleotide
ttccttataataattggttatatgagaggcagttccacgtagtgtaacttatgtcgaataactaattatttcct

SEQ ID NO: 149 - DNA, 70 bp, Artificial Sequence
  Synthetic Oligonucleotide
ttccttataataattggttatatgagaggcagttccacgtagtgtaacttatgtcgaataactaattatt

SEQ ID NO: 150 - DNA, 70 bp, Artificial Sequence
  Synthetic Oligonucleotide
tccttataataattggttatatgagaggcagttccacgtagtgtaatagaatgtcgaataactaattatt

SEQ ID NO: 151 - DNA, 70 bp, Artificial Sequence; identical to SEQ ID NO: 150
  Synthetic Oligonucleotide

SEQ ID NO: 152 - DNA, 70 bp, Artificial Sequence; identical to SEQ ID NO: 150
  Synthetic Oligonucleotide

SEQ ID NO: 153 - DNA, 69 bp, Artificial Sequence
  Synthetic Oligonucleotide
tcttataataattggttatatgagaggcagttacacgtagtgtaatagaatgtcgaataactaattatt

SEQ ID NO: 154 - DNA, 70 bp, Artificial Sequence; identical to SEQ ID NO: 150
  Synthetic Oligonucleotide

SEQ ID NO: 155 - DNA, 70 bp, Artificial Sequence
  Synthetic Oligonucleotide
ccttataataattggttatatgagaggcagttccacgtagtgtaatagaactgtcgaataactaattatt

SEQ ID NO: 156 - DNA, 70 bp, Artificial Sequence; identical to SEQ ID NO: 155
  Synthetic Oligonucleotide

SEQ ID NO: 157 - DNA, 70 bp, Artificial Sequence; identical to SEQ ID NO: 155
  Synthetic Oligonucleotide

SEQ ID NO: 158 - DNA, 70 bp, Artificial Sequence; identical to SEQ ID NO: 155
  Synthetic Oligonucleotide

SEQ ID NO: 159 - DNA, 70 bp, Artificial Sequence; identical to SEQ ID NO: 155
  Synthetic Oligonucleotide

SEQ ID NO: 160 - DNA, 70 bp, Artificial Sequence; identical to SEQ ID NO: 155
  Synthetic Oligonucleotide

SEQ ID NO: 161 - DNA, 70 bp, Artificial Sequence; identical to SEQ ID NO: 155
  Synthetic Oligonucleotide

SEQ ID NO: 162 - DNA, 70 bp, Artificial Sequence; identical to SEQ ID NO: 155
  Synthetic Oligonucleotide

SEQ ID NO: 163 - DNA, 70 bp, Artificial Sequence; identical to SEQ ID NO: 155
  Synthetic Oligonucleotide

SEQ ID NO: 164 - DNA, 70 bp, Artificial Sequence; identical to SEQ ID NO: 155
  Synthetic Oligonucleotide

SEQ ID NO: 165 - DNA, 70 bp, Artificial Sequence; identical to SEQ ID NO: 155
  Synthetic Oligonucleotide

SEQ ID NO: 166 - DNA, 70 bp, Artificial Sequence; identical to SEQ ID NO: 155
  Synthetic Oligonucleotide

SEQ ID NO: 167 - DNA, 70 bp, Artificial Sequence
  Synthetic Oligonucleotide
ccttataataattggttatatgagaggcagttaaacgtagtgtaatagaactgtcgaataactaattatt

SEQ ID NO: 168 - DNA, 70 bp, Artificial Sequence; identical to SEQ ID NO: 155
  Synthetic Oligonucleotide

SEQ ID NO: 169 - DNA, 70 bp, Artificial Sequence; identical to SEQ ID NO: 155
  Synthetic Oligonucleotide

SEQ ID NO: 170 - DNA, 70 bp, Artificial Sequence; identical to SEQ ID NO: 155
  Synthetic Oligonucleotide

SEQ ID NO: 171 - DNA, 70 bp, Artificial Sequence; identical to SEQ ID NO: 155
  Synthetic Oligonucleotide

SEQ ID NO: 172 - DNA, 70 bp, Artificial Sequence
  Synthetic Oligonucleotide
ccttataataattggttatatgagaggcagttccacgtagtgtaatagaactgtcgaataaccaattatt

SEQ ID NO: 173 - DNA, 70 bp, Artificial Sequence; identical to SEQ ID NO: 155
  Synthetic Oligonucleotide

SEQ ID NO: 174 - DNA, 70 bp, Artificial Sequence; identical to SEQ ID NO: 155
  Synthetic Oligonucleotide

SEQ ID NO: 175 - DNA, 70 bp, Artificial Sequence
  Synthetic Oligonucleotide
ccttaaaataataggttatatgagaggcagttccacgtagtgtaatagaactgtcgaataactaattatt

SEQ ID NO: 176 - DNA, 70 bp, Artificial Sequence; identical to SEQ ID NO: 155
  Synthetic Oligonucleotide

SEQ ID NO: 177 - DNA, 70 bp, Artificial Sequence
  Synthetic Oligonucleotide
ccttataataattggttatatgagaggcagttccacgtagtgtactagaactgtcgaataactaattatt

SEQ ID NO: 178 - DNA, 70 bp, Artificial Sequence; identical to SEQ ID NO: 155
  Synthetic Oligonucleotide

SEQ ID NO: 179 - DNA, 70 bp, Artificial Sequence; identical to SEQ ID NO: 155
  Synthetic Oligonucleotide

SEQ ID NO: 180 - DNA, 70 bp, Artificial Sequence
  Synthetic Oligonucleotide
ccttataataattggttatatgagaggcagttccacgtagtctaatagaactgtcgaataactaattatt

SEQ ID NO: 181 - DNA, 70 bp, Artificial Sequence; identical to SEQ ID NO: 155
  Synthetic Oligonucleotide

SEQ ID NO: 182 - DNA, 70 bp, Artificial Sequence; identical to SEQ ID NO: 155
  Synthetic Oligonucleotide

SEQ ID NO: 183 - DNA, 70 bp, Artificial Sequence; identical to SEQ ID NO: 155
  Synthetic Oligonucleotide

SEQ ID NO: 184 - DNA, 70 bp, Artificial Sequence; identical to SEQ ID NO: 155
  Synthetic Oligonucleotide

SEQ ID NO: 185 - DNA, 70 bp, Artificial Sequence; identical to SEQ ID NO: 155
  Synthetic Oligonucleotide

SEQ ID NO: 186 - DNA, 70 bp, Artificial Sequence; identical to SEQ ID NO: 155
  Synthetic Oligonucleotide

SEQ ID NO: 187 - DNA, 70 bp, Artificial Sequence; identical to SEQ ID NO: 155
  Synthetic Oligonucleotide

SEQ ID NO: 188 - DNA, 70 bp, Artificial Sequence; identical to SEQ ID NO: 155
  Synthetic Oligonucleotide

SEQ ID NO: 189 - DNA, 70 bp, Artificial Sequence; identical to SEQ ID NO: 155
  Synthetic Oligonucleotide

SEQ ID NO: 190 - DNA, 70 bp, Artificial Sequence; identical to SEQ ID NO: 155
  Synthetic Oligonucleotide

SEQ ID NO: 191 - DNA, 70 bp, Artificial Sequence; identical to SEQ ID NO: 155
  Synthetic Oligonucleotide

SEQ ID NO: 192 - DNA, 70 bp, Artificial Sequence; identical to SEQ ID NO: 155
  Synthetic Oligonucleotide

SEQ ID NO: 193 - DNA, 70 bp, Artificial Sequence; identical to SEQ ID NO: 155
  Synthetic Oligonucleotide

SEQ ID NO: 194 - DNA, 70 bp, Artificial Sequence; identical to SEQ ID NO: 155
  Synthetic Oligonucleotide

SEQ ID NO: 195 - DNA, 70 bp, Artificial Sequence; identical to SEQ ID NO: 155
  Synthetic Oligonucleotide

SEQ ID NO: 196 - DNA, 70 bp, Artificial Sequence; identical to SEQ ID NO: 155
  Synthetic Oligonucleotide

SEQ ID NO: 197 - DNA, 70 bp, Artificial Sequence; identical to SEQ ID NO: 155
  Synthetic Oligonucleotide

SEQ ID NO: 198 - DNA, 70 bp, Artificial Sequence; identical to SEQ ID NO: 155
  Synthetic Oligonucleotide

SEQ ID NO: 199 - DNA, 70 bp, Artificial Sequence; identical to SEQ ID NO: 155
  Synthetic Oligonucleotide

SEQ ID NO: 200 - DNA, 70 bp, Artificial Sequence; identical to SEQ ID NO: 155
  Synthetic Oligonucleotide

SEQ ID NO: 201 - DNA, 70 bp, Artificial Sequence; identical to SEQ ID NO: 155
  Synthetic Oligonucleotide

SEQ ID NO: 202 - DNA, 70 bp, Artificial Sequence; identical to SEQ ID NO: 155
  Synthetic Oligonucleotide

SEQ ID NO: 203 - DNA, 105 bp, Artificial Sequence
  Synthetic Oligonucleotide
tataaatagattggagtaatatgtgttccttataataattggttatatgagaggcagtttgtcgaataactaattatttgtcgttgttaacagattgctgtcgct

SEQ ID NO: 204 - DNA, 97 bp, Artificial Sequence
  205
atagattggagtaatatgtgttccttataataattggttatatgagaggcaggtcgaataactaattatttgtcgttgttaacagattgctgtcgct

SEQ ID NO: 205 - DNA, 97 bp, Artificial Sequence; identical to SEQ ID NO: 204
  Synthetic Oligonucleotide

SEQ ID NO: 206 - DNA, 98 bp, Artificial Sequence
  Synthetic Oligonucleotide
tagattggagtaatatgtgttccttataataattggttatatgagaggcagttgtcgaataactaattatttgtcgttgttaacagattgctgtcgct

SEQ ID NO: 207 - DNA, 98 bp, Artificial Sequence; identical to SEQ ID NO: 206
  Synthetic Oligonucleotide

SEQ ID NO: 208 - DNA, 98 bp, Artificial Sequence; identical to SEQ ID NO: 206
  Synthetic Oligonucleotide

SEQ ID NO: 209 - DNA, 98 bp, Artificial Sequence; identical to SEQ ID NO: 206
  Synthetic Oligonucleotide

SEQ ID NO: 210 - DNA, 98 bp, Artificial Sequence; identical to SEQ ID NO: 206
  Synthetic Oligonucleotide

SEQ ID NO: 211 - DNA, 97 bp, Artificial Sequence
  Synthetic Oligonucleotide
tagattggagtaatatgtgttccttataataattggttatatgagaggcagttccaaataactaattatttgtcgttgttaacagattgctgtcgct

SEQ ID NO: 212 - DNA, 98 bp, Artificial Sequence; identical to SEQ ID NO: 206
  Synthetic Oligonucleotide

SEQ ID NO: 213 - DNA, 97 bp, Artificial Sequence
  Synthetic Oligonucleotide
tagattggagtaatatgtgttccttataataattggttatatgagaggcagttccacgtaactaattatttgtcgttgttaacagattgctgtcgct

SEQ ID NO: 214 - DNA, 98 bp, Artificial Sequence; identical to SEQ ID NO: 206
  Synthetic Oligonucleotide

SEQ ID NO: 215 - DNA, 97 bp, Artificial Sequence; identical to SEQ ID NO: 213
  Synthetic Oligonucleotide

SEQ ID NO: 216 - DNA, 96 bp, Artificial Sequence
  Synthetic Oligonucleotide
agattggagtaatatgtgttccttataataattggttatatgagaggcagttccagaataactaattattgtcgttgttaacagattgctgtcgct

SEQ ID NO: 217 - DNA, 97 bp, Artificial Sequence
  Synthetic Oligonucleotide
agattggagtaatatgtgttccttataataattggttatatgagaggcagttgtcgaataactaattatttgtcgttgttaacagattgctgtcgct

SEQ ID NO: 218 - DNA, 97 bp, Artificial Sequence; identical to SEQ ID NO: 217
  Synthetic Oligonucleotide

SEQ ID NO: 219 - DNA, 97 bp, Artificial Sequence; identical to SEQ ID NO: 217
  Synthetic Oligonucleotide

SEQ ID NO: 220 - DNA, 97 bp, Artificial Sequence; identical to SEQ ID NO: 217
  Synthetic Oligonucleotide

SEQ ID NO: 221 - DNA, 97 bp, Artificial Sequence; identical to SEQ ID NO: 217
  Synthetic Oligonucleotide

SEQ ID NO: 222 - DNA, 97 bp, Artificial Sequence; identical to SEQ ID NO: 217
  Synthetic Oligonucleotide

SEQ ID NO: 223 - DNA, 97 bp, Artificial Sequence; identical to SEQ ID NO: 217
  Synthetic Oligonucleotide

SEQ ID NO: 224 - DNA, 98 bp, Artificial Sequence
  Synthetic Oligonucleotide
agattggagtaatatgtgttccttataataattggttatatgagaggcagtttgtcgaataactaattatttgtcgttgttaacagattgctgtcgct

SEQ ID NO: 225 - DNA, 97 bp, Artificial Sequence; identical to SEQ ID NO: 217
  Synthetic Oligonucleotide

SEQ ID NO: 226 - DNA, 97 bp, Artificial Sequence; identical to SEQ ID NO: 217
  Synthetic Oligonucleotide

SEQ ID NO: 227 - DNA, 97 bp, Artificial Sequence; identical to SEQ ID NO: 217
  Synthetic Oligonucleotide

SEQ ID NO: 228 - DNA, 97 bp, Artificial Sequence; identical to SEQ ID NO: 217
  Synthetic Oligonucleotide

SEQ ID NO: 229 - DNA, 97 bp, Artificial Sequence
  Synthetic Oligonucleotide
agattggagtaatatgtgttccttataataattggttatatgagaggcagttgtcgaataactaattatttgtcgttgtttacagattgctgtcgct

SEQ ID NO: 230 - DNA, 97 bp, Artificial Sequence; identical to SEQ ID NO: 217
  Synthetic Oligonucleotide

SEQ ID NO: 231 - DNA, 97 bp, Artificial Sequence; identical to SEQ ID NO: 217
  Synthetic Oligonucleotide

SEQ ID NO: 232 - DNA, 97 bp, Artificial Sequence; identical to SEQ ID NO: 217
  Synthetic Oligonucleotide

SEQ ID NO: 233 - DNA, 97 bp, Artificial Sequence; identical to SEQ ID NO: 217
  Synthetic Oligonucleotide

SEQ ID NO: 234 - DNA, 97 bp, Artificial Sequence; identical to SEQ ID NO: 217
  Synthetic Oligonucleotide

SEQ ID NO: 235 - DNA, 97 bp, Artificial Sequence; identical to SEQ ID NO: 217
  Synthetic Oligonucleotide

SEQ ID NO: 236 - DNA, 97 bp, Artificial Sequence; identical to SEQ ID NO: 217
  Synthetic Oligonucleotide

SEQ ID NO: 237 - DNA, 97 bp, Artificial Sequence; identical to SEQ ID NO: 217
  Synthetic Oligonucleotide

SEQ ID NO: 238 - DNA, 97 bp, Artificial Sequence; identical to SEQ ID NO: 217
  Synthetic Oligonucleotide

SEQ ID NO: 239 - DNA, 97 bp, Artificial Sequence; identical to SEQ ID NO: 217
  Synthetic Oligonucleotide

SEQ ID NO: 240 - DNA, 97 bp, Artificial Sequence; identical to SEQ ID NO: 217
  Synthetic Oligonucleotide

SEQ ID NO: 241 - DNA, 97 bp, Artificial Sequence; identical to SEQ ID NO: 217
  Synthetic Oligonucleotide

SEQ ID NO: 242 - DNA, 97 bp, Artificial Sequence; identical to SEQ ID NO: 217
  Synthetic Oligonucleotide

SEQ ID NO: 243 - DNA, 97 bp, Artificial Sequence; identical to SEQ ID NO: 217
  Synthetic Oligonucleotide

SEQ ID NO: 244 - DNA, 97 bp, Artificial Sequence; identical to SEQ ID NO: 217
  Synthetic Oligonucleotide

SEQ ID NO: 245 - DNA, 97 bp, Artificial Sequence; identical to SEQ ID NO: 217
  Synthetic Oligonucleotide

SEQ ID NO: 246 - DNA, 97 bp, Artificial Sequence; identical to SEQ ID NO: 217
  Synthetic Oligonucleotide

SEQ ID NO: 247 - DNA, 97 bp, Artificial Sequence; identical to SEQ ID NO: 217
  Synthetic Oligonucleotide

SEQ ID NO: 248 - DNA, 97 bp, Artificial Sequence
  Synthetic Oligonucleotide
agattggagtaatatgtgttccttataataattggttatataagaggcagttgtcgaataactaattatttgtcgttgttaacagattgctgtcgct

SEQ ID NO: 249 - DNA, 97 bp, Artificial Sequence
  Synthetic Oligonucleotide
agattggagtaatatgtgttccttataataattggttatatgagaggcagttgtcgaataacaaattatttgtcgttgttaacagattgctgtcgct

SEQ ID NO: 250 - DNA, 97 bp, Artificial Sequence; identical to SEQ ID NO: 217
  Synthetic Oligonucleotide

SEQ ID NO: 251 - DNA, 97 bp, Artificial Sequence; identical to SEQ ID NO: 217
  Synthetic Oligonucleotide

SEQ ID NO: 252 - DNA, 97 bp, Artificial Sequence; identical to SEQ ID NO: 217
  Synthetic Oligonucleotide

SEQ ID NO: 253 - DNA, 97 bp, Artificial Sequence; identical to SEQ ID NO: 217
  Synthetic Oligonucleotide

SEQ ID NO: 254 - DNA, 97 bp, Artificial Sequence; identical to SEQ ID NO: 217
  Synthetic Oligonucleotide

SEQ ID NO: 255 - DNA, 97 bp, Artificial Sequence
  Synthetic Oligonucleotide
agattggagtaatatgtgttccttataataattggttatatgagaggcagttgtcgaataactaattatttgtcgttcttaacagattgctgtcgct

SEQ ID NO: 256 - DNA, 97 bp, Artificial Sequence; identical to SEQ ID NO: 217
  Synthetic Oligonucleotide

SEQ ID NO: 257 - DNA, 97 bp, Artificial Sequence; identical to SEQ ID NO: 217
  Synthetic Oligonucleotide

SEQ ID NO: 258 - DNA, 97 bp, Artificial Sequence; identical to SEQ ID NO: 217
  Synthetic Oligonucleotide

SEQ ID NO: 259 - DNA, 97 bp, Artificial Sequence; identical to SEQ ID NO: 217
  Synthetic Oligonucleotide

SEQ ID NO: 260 - DNA, 97 bp, Artificial Sequence; identical to SEQ ID NO: 217
  Synthetic Oligonucleotide

SEQ ID NO: 261 - DNA, 122 bp, Artificial Sequence
  Synthetic Oligonucleotide
gtatccacagctctcattttacagcttccttcccgttccctacagcaatagagggggagccctgtcgaataactaattatttgtcgttgttaacagattgctgtcgctattaacaaattaat

SEQ ID NO: 262 - DNA, 111 bp, Artificial Sequence
  Synthetic Oligonucleotide
agctctcattttacagcttccttcccgttccctacagcaatagaggacttatgtcgaataactaattatttgtcgttgttaacagattgctgtcgctattaacaaattaat

SEQ ID NO: 263 - DNA, 111 bp, Artificial Sequence
  Synthetic Oligonucleotide
gctctcattttacagcttccttcccgttccctacagcaatagagggacttatgtcgaataactaattatttgtcgttgttaacagattgctgtcgctattaacaaattaat

SEQ ID NO: 264 - DNA, 111 bp, Artificial Sequence; identical to SEQ ID NO: 263
  Synthetic Oligonucleotide

SEQ ID NO: 265 - DNA, 111 bp, Artificial Sequence
  Synthetic Oligonucleotide
gctctcattttacagcctccttcccgttccctacagcaatagagggacttatgtcgaataactaattatttgtcgttgttaacagattgctgtcgctattaacaaattaat

SEQ ID NO: 266 - DNA, 112 bp, Artificial Sequence
  Synthetic Oligonucleotide
ctctcattttacagcttccttcccgttccctacagcaatagagggggagccctgtcgaataactaattatttgtcgttgttaacagattgctgtcgctattaacaaattaat

SEQ ID NO: 267 - DNA, 112 bp, Artificial Sequence; identical to SEQ ID NO: 266
  Synthetic Oligonucleotide

SEQ ID NO: 268 - DNA, 111 bp, Artificial Sequence
  Synthetic Oligonucleotide
ctctcattttacagcttccttcccgttccctacagcaatagagggggagccctaacgaataactaattatttgtcgttgttaacagattgctgtcgctataacaaattaat

SEQ ID NO: 269 - DNA, 110 bp, Artificial Sequence
  Synthetic Oligonucleotide
ctctcattttacagcttccttcccgttcactacagcaatagagggacttatgtcgaataactaattatttgtcgttgttaacagattgctgtcgctattaacaaattaat

SEQ ID NO: 270 - DNA, 111 bp, Artificial Sequence
  Synthetic Oligonucleotide
tctcattttacagcttccttcccgttccctacagcaatagagggggagccctgtcgaataactaattatttgtcgttgttaacagattgctgtcgctattaacaaattaat

SEQ ID NO: 271 - DNA, 111 bp, Artificial Sequence; identical to SEQ ID NO: 270
  Synthetic Oligonucleotide

SEQ ID NO: 272 - DNA, 111 bp, Artificial Sequence; identical to SEQ ID NO: 270
  Synthetic Oligonucleotide

SEQ ID NO: 273 - DNA, 111 bp, Artificial Sequence; identical to SEQ ID NO: 270
  Synthetic Oligonucleotide

SEQ ID NO: 274 - DNA, 111 bp, Artificial Sequence; identical to SEQ ID NO: 270
  Synthetic Oligonucleotide

SEQ ID NO: 275 - DNA, 111 bp, Artificial Sequence; identical to SEQ ID NO: 270
  Synthetic Oligonucleotide

SEQ ID NO: 276 - DNA, 111 bp, Artificial Sequence
  Synthetic Oligonucleotide
tctcattttacagcttccttcccgttccctacagcaatagagggggagccctaacgaataactaattatttgtcgttgttaacagattgctgtcgctattaacaaattaat

SEQ ID NO: 277 - DNA, 111 bp, Artificial Sequence; identical to SEQ ID NO: 270
  Synthetic Oligonucleotide

SEQ ID NO: 278 - DNA, 111 bp, Artificial Sequence; identical to SEQ ID NO: 270
  Synthetic Oligonucleotide

SEQ ID NO: 279 - DNA, 111 bp, Artificial Sequence; identical to SEQ ID NO: 270
  Synthetic Oligonucleotide

SEQ ID NO: 280 - DNA, 111 bp, Artificial Sequence; identical to SEQ ID NO: 276
  Synthetic Oligonucleotide

SEQ ID NO: 281 - DNA, 111 bp, Artificial Sequence; identical to SEQ ID NO: 270
  Synthetic Oligonucleotide

SEQ ID NO: 282 - DNA, 111 bp, Artificial Sequence; identical to SEQ ID NO: 270
  Synthetic Oligonucleotide

SEQ ID NO: 283 - DNA, 111 bp, Artificial Sequence; identical to SEQ ID NO: 270
  Synthetic Oligonucleotide

SEQ ID NO: 284 - DNA, 111 bp, Artificial Sequence; identical to SEQ ID NO: 270
  Synthetic Oligonucleotide

SEQ ID NO: 285 - DNA, 111 bp, Artificial Sequence; identical to SEQ ID NO: 270
  Synthetic Oligonucleotide

SEQ ID NO: 286 - DNA, 111 bp, Artificial Sequence; identical to SEQ ID NO: 270
  Synthetic Oligonucleotide

SEQ ID NO: 287 - DNA, 111 bp, Artificial Sequence
  Synthetic Oligonucleotide
tctcattttacagcttccttcccgttccctacagcaatagagggggagccctgtcgaataactaattatttgtcgttgtttacagattgctgtcgctattaacaaattaat

SEQ ID NO: 288 - DNA, 111 bp, Artificial Sequence; identical to SEQ ID NO: 270
  Synthetic Oligonucleotide

SEQ ID NO: 289 - DNA, 111 bp, Artificial Sequence; identical to SEQ ID NO: 270
  Synthetic Oligonucleotide

SEQ ID NO: 290 - DNA, 111 bp, Artificial Sequence; identical to SEQ ID NO: 276
  Synthetic Oligonucleotide

SEQ ID NO: 291 - DNA, 111 bp, Artificial Sequence; identical to SEQ ID NO: 270
  Synthetic Oligonucleotide

SEQ ID NO: 292 - DNA, 111 bp, Artificial Sequence; identical to SEQ ID NO: 270
  Synthetic Oligonucleotide

SEQ ID NO: 293 - DNA, 111 bp, Artificial Sequence; identical to SEQ ID NO: 270
  Synthetic Oligonucleotide

SEQ ID NO: 294 - DNA, 111 bp, Artificial Sequence; identical to SEQ ID NO: 270
  Synthetic Oligonucleotide

SEQ ID NO: 295 - DNA, 111 bp, Artificial Sequence; identical to SEQ ID NO: 270
  Synthetic Oligonucleotide

SEQ ID NO: 296 - DNA, 111 bp, Artificial Sequence; identical to SEQ ID NO: 270
  Synthetic Oligonucleotide

SEQ ID NO: 297 - DNA, 111 bp, Artificial Sequence; identical to SEQ ID NO: 270
  Synthetic Oligonucleotide

SEQ ID NO: 298 - DNA, 111 bp, Artificial Sequence; identical to SEQ ID NO: 270
  Synthetic Oligonucleotide

SEQ ID NO: 299 - DNA, 111 bp, Artificial Sequence; identical to SEQ ID NO: 270
  Synthetic Oligonucleotide

SEQ ID NO: 300 - DNA, 111 bp, Artificial Sequence; identical to SEQ ID NO: 270
  Synthetic Oligonucleotide

SEQ ID NO: 301 - DNA, 114 bp, Artificial Sequence
  Synthetic Oligonucleotide
tctcattttacagcttccttcccgttccctacagcaatagagggggagccctaatgtcgaataactaattatttgtcgttgttaacagattgctgtcgctattaacaaattaat

SEQ ID NO: 302 - DNA, 111 bp, Artificial Sequence; identical to SEQ ID NO: 270
  Synthetic Oligonucleotide

SEQ ID NO: 303 - DNA, 111 bp, Artificial Sequence
  Synthetic Oligonucleotide
tctcattttacagcttccttcccgttccctacagcaatagggggggagccctgtcgaataactaattatttgtcgttgttaacagattgctgtcgctattaacaaattaat

SEQ ID NO: 304 - DNA, 111 bp, Artificial Sequence; identical to SEQ ID NO: 270
  Synthetic Oligonucleotide

SEQ ID NO: 305 - DNA, 110 bp, Artificial Sequence
  Synthetic Oligonucleotide
ctcattttacagcttccttcccgttccctacagcaatagagggggagcttatgtcgaataactattatttgtcgttgttaacagattgctgtcgctattaacaaattaat

SEQ ID NO: 306 - DNA, 111 bp, Artificial Sequence
  Synthetic Oligonucleotide
ctcattttacagcttccttcccgttccctacagcaatagagggggagcttatgtcgaataactaattatttgtcgttgttaacagattgctgtcgctattaacaaattaat

SEQ ID NO: 307 - DNA, 111 bp, Artificial Sequence
  Synthetic Oligonucleotide
ctcattttacagcttccttcccgttccctacagcaatagagggggagcccttgtcgaataactaattatttgtcgttgttaacagattgctgtcgctattaacaaattaat

SEQ ID NO: 308 - DNA, 111 bp, Artificial Sequence; identical to SEQ ID NO: 306
  Synthetic Oligonucleotide

SEQ ID NO: 309 - DNA, 111 bp, Artificial Sequence
  Synthetic Oligonucleotide
gtcctaacctccaggacccacacatggcaatctgaggaactgctcggggagcagagtgcttgtcgaataactaattatttgtcgttgttaacagattgctgtcgctattaa

SEQ ID NO: 310 - DNA, 103 bp, Artificial Sequence
  Synthetic Oligonucleotide
ctccaggacccacacatggcaatctgaggaactgctcggggagcagagtgcttgtcgaataactaattatttgtcgttgttaacagattgctgtcgctattaa

SEQ ID NO: 311 - DNA, 102 bp, Artificial Sequence
  Synthetic Oligonucleotide
ctccaagacccacacatggcaatctgaggaactgctcggggagcagagtgctgtcgaataactaattatttgtcgttgttaacagattgctgtcgctattaa

SEQ ID NO: 312 - DNA, 102 bp, Artificial Sequence
  Synthetic Oligonucleotide
tccaggacccacacatggcaatctgaggaactgctcggggagcagagtgcttgtcgaataactaattatttgtcgttgttaacagattgctgtcgctattaa

SEQ ID NO: 313 - DNA, 102 bp, Artificial Sequence; identical to SEQ ID NO: 312
  Synthetic Oligonucleotide

SEQ ID NO: 314 - DNA, 102 bp, Artificial Sequence; identical to SEQ ID NO: 312
  Synthetic Oligonucleotide

SEQ ID NO: 315 - DNA, 102 bp, Artificial Sequence; identical to SEQ ID NO: 312
  Synthetic Oligonucleotide

SEQ ID NO: 316 - DNA, 102 bp, Artificial Sequence; identical to SEQ ID NO: 312
  Synthetic Oligonucleotide

SEQ ID NO: 317 - DNA, 102 bp, Artificial Sequence; identical to SEQ ID NO: 312
  Synthetic Oligonucleotide

SEQ ID NO: 318 - DNA, 102 bp, Artificial Sequence; identical to SEQ ID NO: 312
  Synthetic Oligonucleotide

SEQ ID NO: 319 - DNA, 102 bp, Artificial Sequence; identical to SEQ ID NO: 312
  Synthetic Oligonucleotide

SEQ ID NO: 320 - DNA, 102 bp, Artificial Sequence; identical to SEQ ID NO: 312
  Synthetic Oligonucleotide

SEQ ID NO: 321 - DNA, 102 bp, Artificial Sequence; identical to SEQ ID NO: 312
  Synthetic Oligonucleotide

SEQ ID NO: 322 - DNA, 102 bp, Artificial Sequence; identical to SEQ ID NO: 312
  Synthetic Oligonucleotide

SEQ ID NO: 323 - DNA, 102 bp, Artificial Sequence; identical to SEQ ID NO: 312
  Synthetic Oligonucleotide

SEQ ID NO: 324 - DNA, 102 bp, Artificial Sequence; identical to SEQ ID NO: 312
  Synthetic Oligonucleotide

SEQ ID NO: 325 - DNA, 102 bp, Artificial Sequence
  Synthetic Oligonucleotide
tccaggacccacacatggcaatctgaggaactgctcggggagcagagtgcttgtcgaataactaattatttgtcgtagttaacagattgctgtcgctattaa

SEQ ID NO: 326 - DNA, 102 bp, Artificial Sequence; identical to SEQ ID NO: 312
  Synthetic Oligonucleotide

SEQ ID NO: 327 - DNA, 102 bp, Artificial Sequence; identical to SEQ ID NO: 312
  Synthetic Oligonucleotide

SEQ ID NO: 328 - DNA, 102 bp, Artificial Sequence; identical to SEQ ID NO: 312
  Synthetic Oligonucleotide

SEQ ID NO: 329 - DNA, 102 bp, Artificial Sequence; identical to SEQ ID NO: 312
  Synthetic Oligonucleotide

SEQ ID NO: 330 - DNA, 102 bp, Artificial Sequence
  Synthetic Oligonucleotide
tccaggacccacacatggcaatctgaggaactgctcggggagcagagtcgttgtcgaataactaattatttgtcgttgttaacagattgctgtcgctattaa

SEQ ID NO: 331 - DNA, 102 bp, Artificial Sequence; identical to SEQ ID NO: 312
  Synthetic Oligonucleotide

SEQ ID NO: 332 - DNA, 102 bp, Artificial Sequence
  Synthetic Oligonucleotide
tccaggacccaaacatggcaatctgaagaactgctcggggagcagagtgcttgtcgaatagctaattatttgtcgttgttaacagattgctgtcgctattaa

SEQ ID NO: 333 - DNA, 102 bp, Artificial Sequence; identical to SEQ ID NO: 312
  Synthetic Oligonucleotide

SEQ ID NO: 334 - DNA, 102 bp, Artificial Sequence; identical to SEQ ID NO: 312
  Synthetic Oligonucleotide

SEQ ID NO: 335 - DNA, 102 bp, Artificial Sequence; identical to SEQ ID NO: 312
  Synthetic Oligonucleotide

SEQ ID NO: 336 - DNA, 102 bp, Artificial Sequence; identical to SEQ ID NO: 312
  Synthetic Oligonucleotide

SEQ ID NO: 337 - DNA, 102 bp, Artificial Sequence
  Synthetic Oligonucleotide
accaggacccacacatggcaatctgaggaactgctcgtggagcagagtgcttgtcgaataactaattatttgtcgttgttaacagattgctgtcgctattaa

SEQ ID NO: 338 - DNA, 102 bp, Artificial Sequence; identical to SEQ ID NO: 312
  Synthetic Oligonucleotide

SEQ ID NO: 339 - DNA, 102 bp, Artificial Sequence
  Synthetic Oligonucleotide
tccaggacccacacatggcaatctgaggaactgctcggggagcagagtgcttgtcgaataactaattatttgtcgttgataacagattgctgtcgctattaa

SEQ ID NO: 340 - DNA, 102 bp, Artificial Sequence; identical to SEQ ID NO: 312
  Synthetic Oligonucleotide

SEQ ID NO: 341 - DNA, 102 bp, Artificial Sequence; identical to SEQ ID NO: 312
  Synthetic Oligonucleotide

SEQ ID NO: 342 - DNA, 102 bp, Artificial Sequence; identical to SEQ ID NO: 312
  Synthetic Oligonucleotide

SEQ ID NO: 343 - DNA, 102 bp, Artificial Sequence; identical to SEQ ID NO: 312
  Synthetic Oligonucleotide

SEQ ID NO: 344 - DNA, 102 bp, Artificial Sequence; identical to SEQ ID NO: 312
  Synthetic Oligonucleotide

SEQ ID NO: 345 - DNA, 102 bp, Artificial Sequence; identical to SEQ ID NO: 312
  Synthetic Oligonucleotide

SEQ ID NO: 346 - DNA, 102 bp, Artificial Sequence; identical to SEQ ID NO: 312
  Synthetic Oligonucleotide

SEQ ID NO: 347 - DNA, 102 bp, Artificial Sequence; identical to SEQ ID NO: 312
  Synthetic Oligonucleotide

SEQ ID NO: 348 - DNA, 102 bp, Artificial Sequence; identical to SEQ ID NO: 312
  Synthetic Oligonucleotide

SEQ ID NO: 349 - DNA, 102 bp, Artificial Sequence; identical to SEQ ID NO: 312
  Synthetic Oligonucleotide

SEQ ID NO: 350 - DNA, 102 bp, Artificial Sequence; identical to SEQ ID NO: 312
  Synthetic Oligonucleotide

SEQ ID NO: 351 - DNA, 102 bp, Artificial Sequence; identical to SEQ ID NO: 312
  Synthetic Oligonucleotide

SEQ ID NO: 352 - DNA, 102 bp, Artificial Sequence; identical to SEQ ID NO: 312
  Synthetic Oligonucleotide

SEQ ID NO: 353 - DNA, 102 bp, Artificial Sequence; identical to SEQ ID NO: 312
  Synthetic Oligonucleotide

SEQ ID NO: 354 - DNA, 102 bp, Artificial Sequence; identical to SEQ ID NO: 312
  Synthetic Oligonucleotide

SEQ ID NO: 355 - DNA, 102 bp, Artificial Sequence; identical to SEQ ID NO: 312
  Synthetic Oligonucleotide

SEQ ID NO: 356 - DNA, 102 bp, Artificial Sequence; identical to SEQ ID NO: 312
  Synthetic Oligonucleotide

SEQ ID NO: 357 - DNA, 102 bp, Artificial Sequence; identical to SEQ ID NO: 312
  Synthetic Oligonucleotide

SEQ ID NO: 358 - DNA, 102 bp, Artificial Sequence
  Synthetic Oligonucleotide
tccaggacccacacatggcaatctgaggaactgctcggggagcagagtgcttgctgaataactaattatttgtcgttgttccacgattgctgtcgctattaa

SEQ ID NO: 359 - DNA, 102 bp, Artificial Sequence
  Synthetic Oligonucleotide
accaggacccacacatggcaatctgaggaactgctcggggagcagagtgcttgtcgaataactaattatttgtcgttgttaacagattgctgtcgctattaa

SEQ ID NO: 360 - DNA, 102 bp, Artificial Sequence; identical to SEQ ID NO: 312
  Synthetic Oligonucleotide

SEQ ID NO: 361 - DNA, 102 bp, Artificial Sequence; identical to SEQ ID NO: 312
  Synthetic Oligonucleotide

SEQ ID NO: 362 - DNA, 102 bp, Artificial Sequence; identical to SEQ ID NO: 312
  Synthetic Oligonucleotide

SEQ ID NO: 363 - DNA, 102 bp, Artificial Sequence
  Synthetic Oligonucleotide
tcaaggacccacacatggcaatctgaggaactgctcggggagcagagtgcttgtcgaataactaattatttgtcgttgttaacagattgctgtcgctattaa

SEQ ID NO: 364 - DNA, 102 bp, Artificial Sequence; identical to SEQ ID NO: 312
  Synthetic Oligonucleotide

SEQ ID NO: 365 - DNA, 102 bp, Artificial Sequence; identical to SEQ ID NO: 312
  Synthetic Oligonucleotide

SEQ ID NO: 366 - DNA, 102 bp, Artificial Sequence; identical to SEQ ID NO: 312
  Synthetic Oligonucleotide

SEQ ID NO: 367 - DNA, 102 bp, Artificial Sequence; identical to SEQ ID NO: 312
  Synthetic Oligonucleotide

SEQ ID NO: 368 - DNA, 26 bp, Artificial Sequence
  Synthetic Oligonucleotide
ggctttctggatgtcctctttaaagg

SEQ ID NO: 369 - DNA, 25 bp, Artificial Sequence
  Synthetic Oligonucleotide
acgtgaccgagggaatgagaaagcc

SEQ ID NO: 370 - DNA, 21 bp, Artificial Sequence
  Synthetic Oligonucleotide
gtcgccctcgatcaggaagtg

SEQ ID NO: 371 - DNA, 18 bp, Artificial Sequence
  Synthetic Oligonucleotide
gtgtgaaagagctgctgg

SEQ ID NO: 372 - DNA, 20 bp, Artificial Sequence
  Synthetic Oligonucleotide
tgtttcgccgctgtcgaaca

SEQ ID NO: 373 - protein, 5 aa, Artificial Sequence
  Synthetic Peptide
GGGGS

SEQ ID NO: 374 - DNA, 24 bp, Artificial Sequence
  Synthetic Oligonucleotide
gacacggatcgacctgtctcagct

SEQ ID NO: 375 - DNA, 21 bp, Artificial Sequence
  Synthetic Oligonucleotide
gtcgccctcgatcaggaagtg

SEQ ID NO: 376 - DNA, 20 bp, Artificial Sequence
  Synthetic Oligonucleotide
tggaagaggataagaagcac

SEQ ID NO: 377 - DNA, 25 bp, Artificial Sequence
  Synthetic Oligonucleotide
agcgcctctatgatcaagagatacg

SEQ ID NO: 378 - DNA, 24 bp, Artificial Sequence
  Synthetic Oligonucleotide
gtctggtgtatcttcttctggcgg

SEQ ID NO: 379 - DNA, 25 bp, Artificial Sequence
  Synthetic Oligonucleotide
gtgtgaaagagctgctggggatcac

SEQ ID NO: 380 - DNA, 22 bp, Artificial Sequence
  Synthetic Oligonucleotide
tgtaatgccgctgtcgaacagc

SEQ ID NO: 381 - DNA, 27 bp, Artificial Sequence
  Synthetic Oligonucleotide
gaagatctcttgcagatagcagatccg

SEQ ID NO: 382 - DNA, 25 bp, Artificial Sequence
  Synthetic Oligonucleotide
tgatccgggaagtgaaagtgatcac

SEQ ID NO: 383 - DNA, 24 bp, Artificial Sequence
  Synthetic Oligonucleotide
gacacggatcgacctgtctcagct

SEQ ID NO: 384 - DNA, 25 bp, Artificial Sequence
  Synthetic Oligonucleotide
acgtgaccgagggaatgagaaagcc

SEQ ID NO: 385 - DNA, 27 bp, Artificial Sequence
  Synthetic Oligonucleotide
gaagatctcttgcagatagcagatccg

SEQ ID NO: 386 - DNA, 25 bp, Artificial Sequence
  Synthetic Oligonucleotide
gtgtgaaagagctgctggggatcac

SEQ ID NO: 387 - DNA, 25 bp, Artificial Sequence
  Synthetic Oligonucleotide
tgatccgggaagtgaaagtgatcac

SEQ ID NO: 388 - DNA, 22 bp, Artificial Sequence
  Synthetic Oligonucleotide
tgtaatgccgctgtcgaacagc

SEQ ID NO: 389 - DNA, 27 bp, Artificial Sequence
  Synthetic Oligonucleotide
gaagatctcttgcagatagcagatccg

SEQ ID NO: 390 - RNA, 50 nt, Artificial Sequence
  Synthetic Oligonucleotide
aaauacagucuugcuuucugacccugguagcugcucacccugaugcugcu

SEQ ID NO: 391 - RNA, 38 nt, Artificial Sequence
  Synthetic Oligonucleotide
gaaaguuggcucgaucauggaccuucccaacaacggug

SEQ ID NO: 392 - protein, 288 aa, Artificial Sequence
  Synthetic Peptide
MDPIRSRTPSPARELLSGPQPDGVQPTADRGVSPPAGGPLDGLPARRTMSRTRLPSPPAPSPAFSADSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 393 - protein, 183 aa, Artificial Sequence
  Synthetic Peptide
RPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRAS

SEQ ID NO: 394 - protein, 4 aa, Artificial Sequence
  Synthetic Peptide
GGGS

SEQ ID NO: 395 - protein, 9 aa, Artificial Sequence
  Synthetic Peptide
GGSGGSGGS

SEQ ID NO: 396 - protein, 15 aa, Artificial Sequence
  Synthetic Peptide
GGGGSGGGGSGGGGS

SEQ ID NO: 397 - protein, 10 aa, Artificial Sequence
  Synthetic Peptide
GGGGSGGGGS

SEQ ID NO: 398 - protein, 20 aa, Artificial Sequence
  Synthetic Peptide
GGGGSGGGGSGGGGSGGGGS

SEQ ID NO: 399 - protein, 25 aa, Artificial Sequence
  Synthetic Peptide
GGGGSGGGGSGGGGSGGGGSGGGGS

SEQ ID NO: 400 - protein, 30 aa, Artificial Sequence
  Synthetic Peptide
GGGGSGGGGSGGGGSGGGGSGGGGSGGGGS

SEQ ID NO: 401 - protein, 35 aa, Artificial Sequence
  Synthetic Peptide
GGGGSGGGGSGGGGSGGGGSGGGGSGGGGSGGGGS

SEQ ID NO: 402 - protein, 30 aa, Artificial Sequence; identical to SEQ ID NO: 400
  Synthetic Peptide

SEQ ID NO: 403 - protein, 45 aa, Artificial Sequence
  Synthetic Peptide
GGGGSGGGGSGGGGSGGGGSGGGGSGGGGSGGGGSGGGGSGGGGS

SEQ ID NO: 404 - protein, 50 aa, Artificial Sequence
  Synthetic Peptide
GGGGSGGGGSGGGGSGGGGSGGGGSGGGGSGGGGSGGGGSGGGGSGGGGS

SEQ ID NO: 405 - protein, 55 aa, Artificial Sequence
  Synthetic Peptide
GGGGSGGGGSGGGGSGGGGSGGGGSGGGGSGGGGSGGGGSGGGGSGGGGSGGGGS

SEQ ID NO: 406 - protein, 60 aa, Artificial Sequence
  Synthetic Peptide
GGGGSGGGGSGGGGSGGGGSGGGGSGGGGSGGGGSGGGGSGGGGSGGGGSGGGGSGGGGS

SEQ ID NO: 407 - protein, 32 aa, Artificial Sequence
  Synthetic Peptide
LEPGEKPYKCPECGKSFSQSGALTRHQRTHTR

SEQ ID NO: 408 - protein, 32 aa, Artificial Sequence; identical to SEQ ID NO: 407
  Synthetic Peptide

SEQ ID NO: 409 - protein, 32 aa, Artificial Sequence; identical to SEQ ID NO: 407
  Synthetic Peptide

SEQ ID NO: 410 - protein, 20 aa, Artificial Sequence
  Synthetic Peptide
PKKKRKVEASSPKKRKVEAS

SEQ ID NO: 411 - DNA, 9 bp, Artificial Sequence
  Synthetic Oligonucleotide
ggtggtagt

SEQ ID NO: 412 - DNA, 27 bp, Artificial Sequence
  Synthetic Oligonucleotide
ggtggtagtggagggagcggcggttca

SEQ ID NO: 413 - DNA, 72 bp, Artificial Sequence
  Synthetic Oligonucleotide
ggtggaggaggctctggtggaggcggtagcggaggcggagggtcgggtggtagtggagggagcggcggttca

SEQ ID NO: 414 - DNA, 48 bp, Artificial Sequence
  Synthetic Oligonucleotide
tcgggatctgagacgcctgggacctcggaatcggctacgcccgaaagt

SEQ ID NO: 415 - DNA, 192 bp, Artificial Sequence
  Synthetic Oligonucleotide
gtggataacaaatttaacaaagaaatgtgggcggcgtgggaagaaattcgtaacctgccgaacctgaacggctggcagatgaccgcgtttattgcgagcctggtggatgatccgagccagagcgcgaacctgctggcggaagcgaaaaaactgaacgatgcgcaggcgccgaaaaccggcggtggttctggt

SEQ ID NO: 416 - DNA, 108 bp, Artificial Sequence
  Synthetic Oligonucleotide
ggtggttctgccggtggctccggttctggctccagcggtggcagctctggtgcgtccggcacgggtactgcgggtggcactggcagcggttccggtactggctctggc

SEQ ID NO: 417 - protein, 7 aa, SV40 virus
PKKKRKV

SEQ ID NO: 418 - protein, 15 aa, Homo sapiens
KRPAATKKAGQAKKK

SEQ ID NO: 419 - protein, 9 aa, Homo sapiens
PAAKRVKLD

SEQ ID NO: 420 - protein, 10 aa, Homo sapiens
RQRRNELKRS

SEQ ID NO: 421 - protein, 38 aa, Homo sapiens
NQSSNFGPMKGGNFGGRSSGPYGGGGQYFAKPRNQGGY

SEQ ID NO: 422 - protein, 42 aa, Homo sapiens
RMRIZFKNKGKDTAELRRRRVEVSVELRKAKKDEQILKRRNV

SEQ ID NO: 423 - protein, 8 aa, Homo sapiens
VSRKRPRP

SEQ ID NO: 424 - protein, 8 aa, Homo sapiens
PPKKARED

SEQ ID NO: 425 - protein, 8 aa, Homo sapiens
PQPKKKPL

SEQ ID NO: 426 - protein, 12 aa, Mus musculus
SALIKKKKKMAP

SEQ ID NO: 427 - protein, 5 aa, Influenza virus
DRLRR

SEQ ID NO: 428 - protein, 7 aa, Influenza virus
PKQKKRK

SEQ ID NO: 429 - protein, 10 aa, Hepatitis delta virus
RKLKKKIKKL

SEQ ID NO: 430 - protein, 10 aa, Mus musculus
REKKKFLKRR

SEQ ID NO: 431 - protein, 20 aa, Homo sapiens
KRKGDEVDGVDEVAKKKSKK

SEQ ID NO: 432 - protein, 17 aa, Homo sapiens
RKCLQAGMNLEARKTKK

SEQ ID NO: 433 - protein, 7 aa, Artificial Sequence
  Synthetic Peptide
ENLYFQG

SEQ ID NO: 434 - DNA, 20 bp, Artificial Sequence
  Synthetic Oligonucleotide
gccaaattggacgaccctcg

SEQ ID NO: 435 - DNA, 20 bp, Artificial Sequence
  Synthetic Oligonucleotide
cgaggagacccccgtttcgg

SEQ ID NO: 436 - DNA, 20 bp, Artificial Sequence
  Synthetic Oligonucleotide
cccgccgccgccgtggctcg

SEQ ID NO: 437 - DNA, 20 bp, Artificial Sequence
  Synthetic Oligonucleotide
tgagctctacgagatccaca

SEQ ID NO: 438 - protein, 353 aa, Scytonema hofmanni
MSTIPIGSYKFSQKLHPLSLLAQLTSRRATGCLRIFTGTVSWSIYLEDGKLTYASYSEKLFDRLDNHLQQLSQQIPALNSATAMQMRLMFEPKGENQPISDADYQAICWLANQAHITSSQAGMLIENLAKEVLELFLTLKEGSYEFSAENSLNQLPKFCSLDLRLLVEHCQKQLRSQQNSQLPLPAPGKTQVEKATRLPQSQMQLGQPLPHQSNFDSQDTNNNKMQGQTASKQLYRVACIDDSQTVLNSIKNFLDENTFSVVLINDPVKALMQILRSKPDLILLDVEMPNLDGYELCSLLRRHSAFKNTPIIMVTGRTGFIDRAKAKMVRASGYLTKPFTQPELLKMVFKHIS

SEQ ID NO: 439 - protein, 468 aa, Artificial Sequence
  Synthetic Peptide
MDYFSTGKIAYPKLTLYAFHLKHSLSQKPKIPVKNANDLWLKCQQLGKQLGIPKLETLPELIEKANNKKTSITGEILPERFLKFTAIQHQPNLHLSGEANPLEIHDTYALDLTLRYPYSEVKLADLRGLNLDDCLLSKNIKASLGQTLVFFAQPVGKIHDEQAFADACVKALLSEEISQKLNIYCQHQGQLLGSPIFEYNNDADFPEKQCHLLIWLNTHDITTELENKGEYYYPLIDLLLCRSKIIYARSEAIWCYEQAKSAYSDLEKYKQEFKEQKNNSIDSKFNNLNQWLQEIPEISFNYVDYLKDLELHKTTIQTNSKNYRLYLEKLNKIGIGSDNLEFLSNFLELAEDTLVEQINTNLAYLTPGQNLFDQMIGTIRGIVELEQAKRDRSLERTIQVLGIAFGGGAIVSGVVTQHIDKPFAPQINFKYPVHPLVSSLLWSVLATAIFGIVAWWVTKPKPKRNKQK

SEQ ID NO: 440 - protein, 112 aa, Artificial Sequence
  Synthetic Peptide
MSDYEITVNTFIHLLNTQSYLFSAEDRITLMKLINNQPDDIKSLSDTISDWCAKHPEVDKALGEFEKIVVRGPGDKQANTNIPKYELDKKNILNEIQQSSSSAKETKKTTST

SEQ ID NO: 441 - protein, 1239 aa, Scytonema hofmanni
MLGERAENLEQAIACHQKAVKIYTLDAFPYEWASTQNNLGAAYRDRILGEQAENLELVIACFQNALKIYTFEAFPDDWANTQDNLGTAYANRIKGEQAENLELAIAAYSAALEVRTRSNFPEDWAMTQNNLGGAYSYRILGNRAENIELAIAACSAALEVTTRSAFPEYWARTQYNLGIAYSQRILGEKTENIETAIAAYSAALEVTTRSAFPIDWARTQNNLGGAYSQRILGEKAENIETAIAAYSVALEVYTRSAFPEYWAGTQYNLGIAYRQRILGNRDENIELAIAAFSAALEVRTRSAFPEDWATTQNDLGIAYGERILGEKAENIELAIAAFSAALEVRTRSAFPVDWADKQNNLGIAYTYRILGEKAENIELAIAAYSAALEVRTRSAFPENWATTQNNLGGAYSQRILGEKAENIELAIAAYSAALEVRTRSAFPEDWAITQNNLGGAYTYRILGEKAENIETAIAAYSAALEVTTRSAFPEDWATTQNNLGIAYGERILGEKAENIELAIAAYSVALEVTTRSAFPVDWASTQHNLGNAYLDRILGEKAENIESAIAAYSSALEVRTRSAFPEKWAGTQNSLGNAYLDRILGEKAENIELAIAAFSAALEVYTRSAFPENWAMTQTNLGGAYRERIFGEKAENIESAITAYTAALEVRTRNAFPQNHATTLLNLGRLYQDEKQLDSAYNTFLQAIETAETLRGGTVSGEEAKRKQAEEWNQLYQRMVAVCLELGKDTEAIEYIERSKTRNLVELILNRDLKTIFPPEVVTQLEQLRDEIATGQYQIQNGKAENPRLLAQHLQELRQQRNELQNRYLPVGYGFKFESFQATLDERTAIIEWYILNDKILAFIVTKTGELTVWQSQPEDIKALVNWGNQYLQNYDDQKDQWLNSLGEELKELASILHIDEILTQIPKHSYKLILIPHFFLHLFPLHALPINQNSENSSCLLDLFAGGVSYAPSCQLLQQVQQRQRPDFQSLFAIQNPTEDLNYTNLEVESILSYFPSHQVLSKKQATKAALSQAATQLKQANYLHFSCHGSFNLNYPQNSFLLLADAYISPIPDDANPERYLKVSDTEAIDLSKCLTLGNLFEQTFDFSQTRLVVLSACETGLIDFNNTSDEYIGLPSGFLYAGSSSVVSSLWTVNDLSTSFLMIKFIQILKNATDMSIPLGMNQAQRWLRDATKEELQEWVKKLALDSTKKGKIRRQINNMTGEQPFNSPFHWAAFTAVGK

SEQ ID NO: 442 - protein, 67 aa, Artificial Sequence
  Synthetic Peptide
MTYLEKLSPWCIVRLKPNMQNQIVARFRRRSDAEAHLQVLRRLIPGVSFTLIFNVGLEQQDLTAVNE

SEQ ID NO: 443 - protein, 100 aa, Artificial Sequence
  Synthetic Peptide
MNPHPLKQREQDLMQLYSYCQLGMTPKQFYSKWQVNYEEMAQICDRSLSTVRRWFARGKNYRRPMPVDLRHLALMNFLLEHFEDIPEEVLQKLCFPEKSE

SEQ ID NO: 444 - protein, 185 aa, Artificial Sequence
  Synthetic Peptide
MLKPVSYKTDQHRAYQQALDDFGITELLAKLNNYSDVDFDSAWIQLQQQEIESLAAILISQLTYSLNGKLIAAYLNLIRHSNQDIVPSLINLKCPDASIELPANFSDVAKTPRFLYGDRLRWLSTESNTDWGIVIGRFYSNACDRCCWSWCYLIWLSKNSPSAAWTSADIAWEEDLEPISEETEL

SEQ ID NO: 445 - protein, 54 aa, Artificial Sequence
  Synthetic Peptide
MGKVTVTLYMEEEDKEALQFLADAEERSLSQMAVLIVKRAIKQAQNDGKIPPKS

SEQ ID NO: 446 - protein, 109 aa, Artificial Sequence
  Synthetic Peptide
MKIEIQGRDAVKATEELLAIEGLEGSYQTIEEVEREGTLATIATIVGIVSGTLTIAESIHKWKEKNQKSLHDPTGARVEKVLIVTDDNRRLLLKDATVEQIKEILENYK

SEQ ID NO: 447 - protein, 964 aa, Scytonema hofmanni
MKILHLYLKLVGDRYAQLRLFWDNPNNCQSRQLPLAEITGLIKKVETDYYTRLPEDYAKTGQALYNWLDGSDRIFQSAIDQHKREVIVLAIAATEKLAHLPWEILHDSTDFLVNRRPFPIIPIRWVKDDDSKQLTPEDQPANRALNVLFMATSPLGIEPELDFEAEEAQVLSATKRQPLSLIVEESGCLKELGYLVDDYDKSYFDVIHLTGHTTFRDGEPRFITETELGQAEYSSAEDIATELQFQLPKLIFLSGCNTGYSSDAGAVPSMAEALLKQGATAVIGWGQRVLDTDAIATAAALYQELSAGKTLTEAIAIAYQVLLKNQARDWHLLRLYVAETLPGALVKRGRKPVPRASVAQEFLDPEKKLRVATRETFVGRRRQLQNCLRVLKPYSEKIGILIHGMGGLGKSTIAARLCDRLSESEKIIGWRQIDESSLVSKLADKLRNAELRTALREGKEELKYRLRDVFAELNQSGEKPFLLVFDDFEWNLEHRQGRYILKTQVAEILKSLVWAIKENNADHRIIITCRYDFESDLDESFYKQPLESFRKSDLQKKLSRLKAFNSEEISLNLIERAKILADGNPRVLEWLNDEVLLGEDAETKLTQLKANPTEWQGRIIWEELYEQLDQDIEQILSRCLVFEIPVPMIALSAVCESTSDYKKQLSRAIELGLIEVSSEAEESNRLYRVSRIIPHIIPNIRLPEAPEVYCLYQKAYEKLHQMWGDKNNRSEEKWQEIFRLKFANKDNPERFRQGFSQMLAVQDNSEADKAFESELRKCTNELEADKLCEALENYLQQEQWKQADKETAWTFYQVMVKENYADWHELLKNFPCETLQEINRLWLENSNNKFGISIQSKIYQSLTGKDNSWNKFCDLVGWRKRGKSQTYNEIVDELTDIKRVVNDTFADVHVPSLPALIYTRLGDGWTTSMGWTVGDERPGFGGFGFLVVACGIENLFSLAESCKD

SEQ ID NO: 448 - protein, 582 aa, Scytonema hofmanni
MKIESFFVNFELLTDAPNAVAKLREIILQLAVRGKLVSQKPNDEPALSSLNRAKIENEFFQQTEIFARDELDSFCPNNRSLATIPHRWEWVSLVEVVDKGKNSIKRGPFGSSIRKEFFVPDGYKVYEQKNAIYDDFQLGYYFINEKKFQELKDFELKPNDIIISCSGTIGRIAVAPESIRQGIINQALLKITLNTKLLSNNYFKILFPAFFMNTSVLTELKGTAIKNIVGVQALKQLLFPLPPIAEQKRIVEKCDRLLSICDEIEKRQQQRQESILRMNESAIAQLLSSQNPDEFRQHWQRIRNNFDLFYSVPETIPKLRQAILQLAVQGKLVRQEFDESALRYLIERITEERLALCPNEKDKQRILSEFGKIIEESAQGKTEEFEIPAICICDFITKGTTPSNSELLPEGEIPYLKVYNIVDNKIDFFYKPTYISRTVHTTKLKRSLVCPGDVLMNIVGPPLGKIAIVPDDFPEWNINQALAVFRPVDSVYNRFMYYALSSYATLEKVLNETKGTAGQDNLSLEQCRSLRIPLYTIETQKRIVEKCDRLMSLCDTLEAKLKQGRDSSEKLMEVAAKQVLTA

SEQ ID NO: 449 - protein, 480 aa, Scytonema hofmanni
MSISTTIKTIQDIMRKDAGVDGDAQRINQLVWMIFLKVFDAREEEYELLEDNYQSPIPEGLRWRNWAADSEGITGDGLLDFVDNALFKTLKELRTTATDARGQMIGKVFEDAYNYMKNGTLIRQVINKLNEVDFNKKDQKKQFSEIYEKILKDLQSAGNAGEYYTPRAVTKFIVDRIKPQLGEIVFDPACGTGGFLTAAIDYIRQNFQSADVPETLQRTIRGTEKKPLPFNLCVTNLILHGIDVPSAEHDNTLARPLRDYSPHERVDVIITNPPFGGMEEDGIEDNFPATFRTRETADLFLVLIAHLLKEGGRGAIVLPDGTLFGEGVKTRIKEKLLQDCNLHTIVRLPNGVFNPYTSIKTNLLFFTKGEPTERIWYYEHPYPAGYKSYSKTKPIRFEEFAPEQEWWDNREKNEFAWQVSIADLKANNYNIDIKNPHKVDVEHADLDEMLAEHQKLMAELGEVRSKLKFELIEALEIDED

SEQ ID NO: 450 - protein, 777 aa, Scytonema hofmanni
MPEAIDKKSLSERDICTKYITPALTNRAWDINTQIREEVTLTKGRVIVRGKLASRGEQKRADYVLYHKPGVPLAVIEAKDNNHGVSAGMQQAIATGELIDVPFIFSSNGDAFMMCDRTITEGQREREIPLEQFPTPQELWQKYCDWKGIDSEIQPIVSQDYYPSSDKKQPRYYQQIAINRTIEAIAKGENRILLVMATGTGKTFTAFQIIWRLWKSGAKKRILFLADRNILVDQTRVNDFKPFGSRMTKIQKRQIDKSYEIYLCLYQAVTGNEEAKNIYRQFSPDFFDLIIIDECHRGSANEDSAWREILEYFRNATQIGLTATPRETEEASNINYFGESLFTYSLKQGIEDGFLAPYKVIRIDLDKDLSGWKPKPGQRDKYGKPIPDQVYNQRDFDRTLVLEKRTELVARIISDYLKSSDRFAKTIIFCETTDHAERMRVALVNENADLVAGNSRYIMRITGDDAQGKAELDNFIDPESKYPTIVTTSELLTTGVDAKTCKLIVLDQRILSMTKFKQIIGRGTRIDEDYGKMFFTIMDFKKATELFADPDFDGDPVQIYQPKPVDPIVPPDTGDDEVVIDDGEISRKQTRDRYVIADEEVSIAFIREQYYGKDGKLITESIKDYTRKTVSQEYASLDAFLKKWHSTEQKQAIIRELQELGVPLEALEKEIGRDFDPLDLICHVVFDQPPLTRKERANNVRKRNYFSNYGEQARTVLNALLDKYADEGIEDIESLDVLKVQPISDLGTPLEIISIFGGKQAYLQALSVLKSEIYRVS

SEQ ID NO: 451 - protein, 150 aa, Scytonema hofmanni
MEGKFYTSTEAAQITNCSRRQLQYWRDKGVVVPTVNTTGKGRNVYYSISDLLVLTVMHYLLSVGLSFEVSRQTLVILRQKEPWLFEEFVPKEKMKRLMLLTTCSLEQPLTLAEFDKEAALEALCQGQTVIPFWCDRIHQQLRDNLKSFSS

SEQ ID NO: 452 - DNA, 37 bp, Artificial Sequence
  Synthetic Oligonucleotide
gtggcaacaaccttccaggtactaggtgggttgaaag

SEQ ID NO: 453 - DNA, 37 bp, Artificial Sequence; identical to SEQ ID NO: 452
  Synthetic Oligonucleotide

SEQ ID NO: 454 - DNA, 37 bp, Artificial Sequence; identical to SEQ ID NO: 452
  Synthetic Oligonucleotide

SEQ ID NO: 455 - DNA, 37 bp, Artificial Sequence; identical to SEQ ID NO: 452
  Synthetic Oligonucleotide

SEQ ID NO: 456 - DNA, 37 bp, Artificial Sequence; identical to SEQ ID NO: 452
  Synthetic Oligonucleotide

SEQ ID NO: 457 - DNA, 37 bp, Artificial Sequence; identical to SEQ ID NO: 452
  Synthetic Oligonucleotide

SEQ ID NO: 458 - DNA, 37 bp, Artificial Sequence; identical to SEQ ID NO: 452
  Synthetic Oligonucleotide

SEQ ID NO: 459 - DNA, 37 bp, Artificial Sequence; identical to SEQ ID NO: 452
  Synthetic Oligonucleotide

SEQ ID NO: 460 - DNA, 37 bp, Artificial Sequence; identical to SEQ ID NO: 452
  Synthetic Oligonucleotide

SEQ ID NO: 461 - protein, 400 aa, Scytonema hofmanni
MLVFEAKLEGTKQQYEQLDEAIRTARFIRNSCIRYWMDNPYIGRYELSAYCVVLQREFPFANKLNSMARQASAERAWSAIARFYDNCKKKAAKKGFPRFKKHQTHGSVEYKTCGWKLSEDRRTITFTDGFKAGSFKMWGTRDLHFYQLKQIKRVRAVRRADGYYVQFCLDVERVEKREPTGKTIGLDVGLAHFYTDSDGKTVENPRHLRKSEKALNRLGRRLSRTTKGSKNRAKSRNRLSRKHLKVSRQRKDFAVKLARCVIQSNDLVAYEDLQVRNMVKNRKLSKSISDAAWSAFRNWLEYFGKVFGVATVAVPPHYTSQNCSKCGEVIKKSLSQRTHKCHQCGLVLDTDWNAARNILELALRTVGHTGTLNASGDISLCMSEEIPSSKLSRGKRKPKE

SEQ ID NO: 462 - RNA, 144 nt, Artificial Sequence; identical to SEQ ID NO: 1
  Synthetic Oligonucleotide

SEQ ID NO: 463 - RNA, 115 nt, Artificial Sequence; identical to SEQ ID NO: 2
  Synthetic Oligonucleotide

SEQ ID NO: 464 - RNA, 89 nt, Artificial Sequence; identical to SEQ ID NO: 3
  Synthetic Oligonucleotide

SEQ ID NO: 465 - RNA, 81 nt, Artificial Sequence; identical to SEQ ID NO: 4
  Synthetic Oligonucleotide

SEQ ID NO: 466 - DNA, 8057 bp, Artificial Sequence
  Synthetic Oligonucleotide
gttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcaacgccaagctccaaaacgatctcaagaagatcatcttattaattttacactttatgcttccggctcgtatgttgaaagaggagaaaggatctatgaacagtcagcaaaatcctgatttagctgttcatcccttggcaattcctatggaaggcttactaggagaaagtgctacaactcttgagaagaatgtaattgccacacaactctcagaggaagcccaagtaaagctagaggtaatccaaagtttactggaaccctgcgatcgcacaacttatgggcaaaagttgcgggaagcagcagagaaactaaatgtatcgttgcgaacggtacaaaggttggtgaaaaactgggaacaagatggcttagtcggactcactcaaacaagtagggctgataaaggaaaacaccgcattggtgagttttgggaaaacttcattaccaaaacctacaaggagggtaacaagggaagtaaacgtatgacccctaaacaagttgctctcagagtcgaggctaaagcccgtgaattaaaagactctaagccgcccaattacaaaaccgtgttacgggtattagcacccattttggaaaagcaacaaaaagccaagagtatccgcagtcctggttggagaggaactacgctttcggttaaaacccgtgaaggaaaagatttatcggttgattacagtaaccatgtttggcaatgtgaccatacccgcgtggatgtgttgctggtagatcaacatggtgaaattttaagtcgtccctggctaacaacagtaattgatacttactctcgttgcattatgggtatcaacttgggctttgatgcacccagttctggggtagtagcattagcgttacgccatgcaattctaccaaagcgttacggttccgagtacaaactgcattgtgagtggggaacctatggaaaaccagaacatttttatactgatggcggtaaagactttcgctctaaccacttgagtcagattggggcgcaattgggatttgtctgtcatttacgcgatcgcccttctgaaggtggagtagtagaacgtcccttcaaaacattaaatgaccaactattttcaacgcttcctgggtacaccggatctaatgtgcaggaacgcccagaagatgcagagaaggacgcaagacttactttgcgagaactagaacagttacttgtgcgttacatcgtagatcgttacaaccaaagtattgatgcgcggatgggcgaccaaacgcgctttgagcgttgggaagcaggattgcctacagtgccagtaccaataccagaacgagatttggatatttgtttaatgaagcagtcacggcgcactgtgcaaagaggtggttgtttgcagtttcagaatttaatgtatcggggggaatatttggcaggttatgccggagaaactgtcaacttaaggtttgaccccagagacattacaacaattttggtttatcgccaggaaaacaatcaggaagtatttctgactcgcgctcacgctcaaggtttggagacagagcaactggcattagatgaggctgaggcagcaagtcgcagactccgtaccgcagggaaaactatcagtaaccaatcattattgcaagaagttgttgaccgcgatgctcttgtcgctaccaagaaaagccgtaaggagcgtcaaaaattggaacagactgttttgcgatctgctgctgttgatgaaagtaatagagaatccttgccttctcaaatagttgaaccagatgaagtggaatctacagaaacggttcactctcaatacgaagacattgaggtgtgggactatgaacaacttcgtgaagaatatgggttttaaacaatgacagaagctcaggcgatcgccaagcagttgggtggggtaaaaccggatgatgagtggttacaagctgaaattgctcgtctcaagggtaagagcattgtgcctttacagcaggtaaaaactctccatgattggttagatggcaagcgcaaggcaagaaaatcttgccgagtagttggggaatcgagaactggcaagacagttgcttgtgatgcctacagatacaggcacaaacctcagcaggaagctggacgacctccaactgtgcctgtcgtttatattcgacctcaccaaaaatgtggccccaaggatttgtttaaaaagattactgagtacctcaagtatcgggtaacaaaagggactgtatctgattttcgagataggacgatagaagtactcaagggttgtggcgtagagatgctaattattgatgaagctgaccgtctcaagcctgaaacttttgctgatgtgcgagatattgccgaagatttaggaattgctgtggtactggtaggaacagaccgtttggatgcggtaattaagcgggatgagcaggttctcgaacgctttcgggcgcatcttcgctttggtaaattgtcgggagaggattttaagaacaccgtagaaatgtgggaacaaatggttttgaaactgccagtatcttctaatctaaagagcaaggagatgctacggattctcacgtcagcaactgaaggctacattggtcgccttgatgagattcttagggaagctgcaattcgttccttatcaagaggattgaagaagattgacaaggctgttttacaggaagtagctaaggagtacaaatgatagaagcaccagatgttaaaccttggctattcttgattaaaccctatgaaggggaaagcctgagccactttcttggcaggttcagacgtgccaaccatttatccgcaagtggattgggtactttggcaggaattggtgctatagtggcacgttgggaaagatttcattttaatcctcgccctagtcagcaagaattggaagcgatcgcatctgtagtagaagtggatgctcaaaggttagcccagatgttaccgcctgctggagtgggaatgcagcatgagccaattcgcttgtgtggggcttgttatgccgagtcgccttgtcaccgaattgaatggcagtacaagtcggtgtggaagtgcgatcgccatcaactcaagattttagcaaagtgtccaaactgtcaagcaccttttaaaatgcctgcgctgtgggaggatgggtgctgtcacagatgtaggatgccgtttgcagaaatggcaaagctacagaaggtttgatgataaaaccagaaaaaggtgtgaaattaactaagtccctgaattgatctggttgtccaaaaaatttgtgcgatcgcatggcaagattattcctactattgatgtggcgtgagtcggataacttgctctaatgctgataaaaccagaaaaaggtgtgaaattaactaagtccctgaattgatctggttgtccaaaaaatttgtgcgatcgcatggcaagattattcctactattgatgtggtttacactttatgcttccggctcgtatgttgaaagaggagaaaggatctatgagtcaaataactattcaagctcgacttatttcctttgaatcaaaccgccaacaactctggaagttgatggcagatttaaacacgccgttaattaacgaactgctttgccagttaggtcaacaccccgacttcgagaagtggcaacaaaagggtaaactcccgtctaccgttgtgagccagttatgtcaacctctcaaaactgaccctcgctttgcaggtcagcccagccgtttatatatgtcggcaattcatattgtggactacatctacaagtcctggctggctatacagaaacggcttcaacagcagctagatggaaagacgcgctggctagaaatgctcaatagcgatgctgaattagtagaacttagtggtgacactttagaggctattcgtgtcaaagctgctgaaattttggcaatagctatgccagcatctgagtcagatagcgcttcacctaaagggaaaaaaggtaaaaaggagaaaaaaccctcatcttctagccctaagcgtagtttatccaagacattatttgacgcttaccaagaaacggaagatatcaagagccgtagcgccatcagctacctgttaaaaaatggctgcaaacttactgacaaagaagaagattcagaaaaatttgctaaacgtcgtcgtcaagttgaaatccaaattcaaaggcttaccgaaaagttaataagtcggatgcctaaaggtcgagatttgaccaatgctaaatggttggagacactcttgactgctacaaccactgttgctgaagacaacgcccaagccaaacgctggcaggatattctgttaactcgatcaagttctctcccattcccccttgtttttgaaaccaacgaggatatggtttggtcaaagaatcaaaagggtaggctgtgtgttcacttcaatggcttaagcgatttaatttttgaggtgtactgcggcaatcgtcaacttcactggtttcaacgcttcctagaagaccaacagactaaacgcaaaagcaaaaatcagcattctagcggcttgttcacactcagaaatggtcatctagtttggcttgaaggtgagggtaaaggggaaccttggaatcttcaccacttgaccctttactgctgtgttgacaatcgcttgtggacagaggagggaacagaaatcgttcgccaagagaaagcagatgaaattactaaattcatcacaaacatgaagaagaaaagcgatctaagcgatacacagcaagctttgattcaacgtaaacaatcaacacttactcgaataaacaattcctttgagcgtcctagccaacccctttatcaaggtcaatcacacattttggttggagtaagcctgggactagaaaaacctgccacagtagcagtagtagatgcgatcgccaacaaagtcttggcttaccggagtattaaacaattacttggcgacaattacgaactgctaaatcgccagagacgacaacagcagtacctatctcacgaacgccacaaagcacaaaaaaacttctctcccaatcaatttggagcatctgagttagggcaacatatagacagattattagctaaagcaattgtagcgttagcgagaacctacaaagctggcagtattgtcttgcccaagttaggggatatgcgggaggttgtccaaagtgaaattcaagctatagcagaacaaaaatttcccggttatattgaaggtcagcaaaaatatgccaaacagtaccgggttaatgttcatcggtggagctacggcagattaattcaaagcattcaaagtaaagcagctcaaacaggaattgtgattgaggagggaaaacaacctattcgaggtagtccccacgacaaagcaaaggaattagcactttctgcttacaatctccgcctaactaggcgaagttaacaaatatctgaaccttgataatagaatattaatagcgccgcaattcatgctgcttgcagcctctgaattttgttaaatgagggttagtttgactgtataaatacagtcttgctttctgaccctggtagctgctcaccctgatgctgctgtcaatagacaggataggtgcgctcccagcaataagggcgcggatgtactgctgtagtggctactgaatcacccccgatcaagggggaaccctccccaattcttcatttgaaggactaaaatcaaggcaaaatttctaagagatccgcgcaagttccaaataccttatctcgtcttgatttcatctttttttaaccaaggcatgattcttgagactgaggctcaaatgagaaattgggaaacatccgcgctgaagatatctggaaaggttggctcacaacattttgtaactgggtagttgacagctagctcagtcctaggtataatgctagcgtggcaacaaccttccaggtactaggtgggttgaaaggagaagtcatttaataaggccactgttaaaagtggcaacaaccttccaggtactaggtgggttgaaagcggccgacgcgctgggctacatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaa

SEQ ID NO: 467 - DNA, 4598 bp, Artificial Sequence
  Synthetic Oligonucleotide
tggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagccggttgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacttgagagcttagtacgtgaaacatgagagcttagtacgtactatcaacaggttgaactgcccatgttctttcctgcgttatcagagcttatcggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaagtaaaaaatttttagtttattagacatctccacaaaaggcgtagtgtacagtgacaaattatctgtcgtcggtgacagattaatgtcattgtgactatttaattgtcgtcgtgacccatcagcgttgcttaattaattgatgacaaattaaatgtcatcaatataatatgctctgcaattattatacaaagcaattaaaacaagcggataaaaggacttgctttcaacccacccctaagtttaatagttactgagggggatccactagtgagctcatgcatgatctcgaattagcttcaaaagcgctctgaagttcctatactttctagagaataggaacttcggaataggaacttcaagatcccctgattccctttgtcaacagcaatggataattcgatttaacaaatgcatggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgaggatccaacatttccaatcactagtgaattatctagaattattccattgagtaagtttttaagcacatcagcttcaaaagcgctctgaagttcctatactttctagagaataggaacttcggaataggtacttcaagatccccaattcgagatcgtccgggccgcaagctcctagcggcggatttgtcctactcaggagagcgttcaccgacaaacaacagataaaacgaaaggcccagtctttcgactgagcctttcgttttatttgatgcctcaagctagagagtcattaccccaggcgtttaagggcaccaataactgccttaaaaaaattacgccccgccctgccactcatcgcagtctagcttggattctcaccaataaaaaacgcccggcggcaaccgagcgttctgaacaaatccagatggagttctgaggtcattactggatctatcaacaggagtccaagctcagctaattaaggcgacagtcaatttgtcattatgaaaatacacaaaagctttttcctatcttgcaaagcgacagctaatttgtcacaatcacggacaacgacatctattttgtcactgcaaagaggttatgctaaaactgccaaagcgctataatctatactgtataaggattttactgatgacaataatttgtcacaacgacatataattagtcactgtacacgtagagacgtagcaatgctacctctctacaatggttttgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataa

SEQ ID NO: 468 - RNA, 215 nt, Artificial Sequence
  Synthetic Oligonucleotide
auauuaauagcgccgcaauucaugcugcuugcagccucugaauuuuguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaaccc

SEQ ID NO: 469 - RNA, 169 nt, Artificial Sequence
  Synthetic Oligonucleotide
uuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccu

SEQ ID NO: 470 - RNA, 188 nt, Artificial Sequence
  Synthetic Oligonucleotide
uuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuccaaaagguggguugaaag

SEQ ID NO: 471 - RNA, 188 nt, Artificial Sequence; identical to SEQ ID NO: 470
  Synthetic Oligonucleotide

SEQ ID NO: 472 - RNA, 179 nt, Artificial Sequence
  Synthetic Oligonucleotide
gguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuccaaaagguggguugaaag

SEQ ID NO: 473 - RNA, 188 nt, Artificial Sequence
  Synthetic Oligonucleotide
uuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccaccaaaagguggguugaaag

SEQ ID NO: 474 - RNA, 179 nt, Artificial Sequence
  Synthetic Oligonucleotide
gguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccaccaaaagguggguugaaag

SEQ ID NO: 475 - RNA, 183 nt, Artificial Sequence
  Synthetic Oligonucleotide
uuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuaaauggguugaaag

SEQ ID NO: 476 - RNA, 174 nt, Artificial Sequence
  Synthetic Oligonucleotide
gguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuaaauggguugaaag

SEQ ID NO: 477 - DNA, 203 bp, Artificial Sequence
  Synthetic Oligonucleotide
agcctctgaattttguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuccaaaagguggguugaaag

SEQ ID NO: 478 - RNA, 218 nt, Artificial Sequence
  Synthetic Oligonucleotide
auucaugcugcuugcagccucugaauuuuguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuccaaaagguggguugaaag

SEQ ID NO: 479 - RNA, 235 nt, Artificial Sequence
  Synthetic Oligonucleotide
auauuaauagcgccgcaauucaugcugcuugcagccucugaauuuuguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuccaaaagguggguugaaag

SEQ ID NO: 480 - RNA, 230 nt, Artificial Sequence
  Synthetic Oligonucleotide
auauuaauagcgccgcaauucaugcugcuugcagccucugaauuuuguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuaaauggguugaaag

SEQ ID NO: 481 - RNA, 206 nt, Artificial Sequence
  Synthetic Oligonucleotide
ugcagccucugaauuuuguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuccaaaagguggguugaaag

SEQ ID NO: 482 - RNA, 201 nt, Artificial Sequence
  Synthetic Oligonucleotide
ugcagccucugaauuuuguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuaaauggguugaaag

SEQ ID NO: 483 - DNA, 31 bp, Artificial Sequence
  Synthetic Oligonucleotide
gagaagtcatttaataaggccactgttaaaa

SEQ ID NO: 484 - RNA, 81 nt, Artificial Sequence; identical to SEQ ID NO: 4
  Synthetic Oligonucleotide

SEQ ID NO: 485 - RNA, 89 nt, Artificial Sequence; identical to SEQ ID NO: 3
  Synthetic Oligonucleotide

SEQ ID NO: 486 - RNA, 115 nt, Artificial Sequence; identical to SEQ ID NO: 2
  Synthetic Oligonucleotide

SEQ ID NO: 487 - RNA, 144 nt, Artificial Sequence; identical to SEQ ID NO: 1
  Synthetic Oligonucleotide

SEQ ID NO: 488 - RNA, 169 nt, Artificial Sequence; identical to SEQ ID NO: 469
  Synthetic Oligonucleotide

SEQ ID NO: 489 - RNA, 215 nt, Artificial Sequence; identical to SEQ ID NO: 468
  Synthetic Oligonucleotide

SEQ ID NO: 490 - RNA, 258 nt, Artificial Sequence
  Synthetic Oligonucleotide
  misc_feature (236)..(258): n is a, c, g, or u
auauuaauagcgccgcaauucaugcugcuugcagccucugaauuuuguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuccaaaagguggguugaaagnnnnnnnnnnnnnnnnnnnnnnn

SEQ ID NO: 491 - RNA, 253 nt, Artificial Sequence
  Synthetic Oligonucleotide
  misc_feature (231)..(253): n is a, c, g, or u
auauuaauagcgccgcaauucaugcugcuugcagccucugaauuuuguuaaaugaggguuaguuugacuguauaaauacagucuugcuuucugacccugguagcugcucacccugaugcugcugucaauagacaggauaggugcgcucccagcaauaagggcgcggauguacugcuguaguggcuacugaaucacccccgaucaagggggaacccuaaauggguugaaagnnnnnnnnnnnnnnnnnnnnnnn

SEQ ID NO: 492 - RNA, 38 nt, Artificial Sequence
  Synthetic Oligonucleotide
  misc_feature (16)..(38): n is a, c, g, or u
aaggagggaagaaagnnnnnnnnnnnnnnnnnnnnnnn

SEQ ID NO: 493 - DNA, 23 bp, Artificial Sequence
  Synthetic Oligonucleotide
tcagaaggttagcatcaaatgat

SEQ ID NO: 494 - DNA, 20 bp, Artificial Sequence
  Synthetic Oligonucleotide
agataaccgggcacgttttt

SEQ ID NO: 495 - DNA, 20 bp, Artificial Sequence
  Synthetic Oligonucleotide
ttcctccacatccactgtct

SEQ ID NO: 496 - DNA, 23 bp, Artificial Sequence
  Synthetic Oligonucleotide
tgtgaagtaataccctaaccacc

SEQ ID NO: 497 - DNA, 20 bp, Artificial Sequence
  Synthetic Oligonucleotide
gagccggtgtggaatggtaa

SEQ ID NO: 498 - DNA, 20 bp, Artificial Sequence
  Synthetic Oligonucleotide
attctggcgcttgctacctt

SEQ ID NO: 499 - DNA, 23 bp, Artificial Sequence
  Synthetic Oligonucleotide
ttacatgtcctgtacccggcaga

SEQ ID NO: 500 - DNA, 20 bp, Artificial Sequence
  Synthetic Oligonucleotide
acgaaaggcaggtgagaagg

SEQ ID NO: 501 - DNA, 20 bp, Artificial Sequence
  Synthetic Oligonucleotide
accattctcacccggcaatt

SEQ ID NO: 502 - DNA, 23 bp, Artificial Sequence
  Synthetic Oligonucleotide
atagtgaatccgcttattctcag

SEQ ID NO: 503 - DNA, 20 bp, Artificial Sequence
  Synthetic Oligonucleotide
acgttcgaaaggcgtaccaa

SEQ ID NO: 504 - DNA, 20 bp, Artificial Sequence
  Synthetic Oligonucleotide
tgagtgccattgtagtgcga

SEQ ID NO: 505 - DNA, 23 bp, Artificial Sequence
  Synthetic Oligonucleotide
ggattcacacaacgaaacaatta

SEQ ID NO: 506 - DNA, 20 bp, Artificial Sequence
  Synthetic Oligonucleotide
caggatccaggattcacggg

SEQ ID NO: 507 - DNA, 20 bp, Artificial Sequence
  Synthetic Oligonucleotide
aaccgggtattccacacacc

SEQ ID NO: 508 - DNA, 23 bp, Artificial Sequence
  Synthetic Oligonucleotide
tattgcgaagggagggtgacgaa

SEQ ID NO: 509 - DNA, 20 bp, Artificial Sequence
  Synthetic Oligonucleotide
ttggtagacgcgctagcttc

SEQ ID NO: 510 - DNA, 20 bp, Artificial Sequence
  Synthetic Oligonucleotide
tcggtttcgccatcacatga

SEQ ID NO: 511 - DNA, 23 bp, Artificial Sequence
  Synthetic Oligonucleotide
ctgtgccaaaagcggaagttgga

SEQ ID NO: 512 - DNA, 20 bp, Artificial Sequence
  Synthetic Oligonucleotide
agccagaaatatgccgagcc

SEQ ID NO: 513 - DNA, 20 bp, Artificial Sequence
  Synthetic Oligonucleotide
ggcagaccagaaagcgtttg

SEQ ID NO: 514 - DNA, 20 bp, Artificial Sequence
  Synthetic Oligonucleotide
ggcagaccagaaagcgtttg

SEQ ID NO: 515 - DNA, 20 bp, Artificial Sequence
  Synthetic Oligonucleotide
gcggccgccaattttagttt

SEQ ID NO: 516 - DNA, 20 bp, Artificial Sequence
  Synthetic Oligonucleotide
gctcggcatatttgtctgcg

SEQ ID NO: 517 - DNA, 23 bp, Artificial Sequence
  Synthetic Oligonucleotide
tcagacctatttggccggtaatc

SEQ ID NO: 518 - DNA, 20 bp, Artificial Sequence
  Synthetic Oligonucleotide
cagattgccgcggctttaat

SEQ ID NO: 519 - DNA, 20 bp, Artificial Sequence
  Synthetic Oligonucleotide
gtcccagtccgatctcttgc

SEQ ID NO: 520 - DNA, 23 bp, Artificial Sequence
  Synthetic Oligonucleotide
atgccggtcattccggggttttg

SEQ ID NO: 521 - DNA, 20 bp, Artificial Sequence
  Synthetic Oligonucleotide
cgtttcgttttccggtgctt

SEQ ID NO: 522 - DNA, 20 bp, Artificial Sequence
  Synthetic Oligonucleotide
aagaagcctcaccacaaccc

SEQ ID NO: 523 - DNA, 23 bp, Artificial Sequence
  Synthetic Oligonucleotide
ttaggataattggaatgaatatc

SEQ ID NO: 524 - DNA, 20 bp, Artificial Sequence
  Synthetic Oligonucleotide
cgcgtcttatcaggcctaca

SEQ ID NO: 525 - DNA, 20 bp, Artificial Sequence
  Synthetic Oligonucleotide
acccaaaaacatttcgggcg

SEQ ID NO: 526 - DNA, 23 bp, Artificial Sequence
  Synthetic Oligonucleotide
ttcaaaagagtataaatgcctga

SEQ ID NO: 527 - DNA, 20 bp, Artificial Sequence
  Synthetic Oligonucleotide
tgggttgaacataacgccga

SEQ ID NO: 528 - DNA, 20 bp, Artificial Sequence
  Synthetic Oligonucleotide
gcaagtaagcccgcaatagc

SEQ ID NO: 529 - DNA, 23 bp, Artificial Sequence
  Synthetic Oligonucleotide
tttgcggcattaacgctcaccag

SEQ ID NO: 530 - DNA, 20 bp, Artificial Sequence
  Synthetic Oligonucleotide
gaacggcctcagtagtctcg

SEQ ID NO: 531 - DNA, 20 bp, Artificial Sequence
  Synthetic Oligonucleotide
tgtttagagtgttccccgcg

SEQ ID NO: 532 - DNA, 23 bp, Artificial Sequence
  Synthetic Oligonucleotide
accctcttaaactatcccactaa

SEQ ID NO: 533 - DNA, 20 bp, Artificial Sequence
  Synthetic Oligonucleotide
aaggctgggaaatcagacgg

SEQ ID NO: 534 - DNA, 20 bp, Artificial Sequence
  Synthetic Oligonucleotide
tatctgcaaagtcgctgggg

SEQ ID NO: 535 - DNA, 23 bp, Artificial Sequence
  Synthetic Oligonucleotide
aacctcactactatcgaagactc

SEQ ID NO: 536 - DNA, 20 bp, Artificial Sequence
  Synthetic Oligonucleotide
cgattggcattaacccgctt

SEQ ID NO: 537 - DNA, 20 bp, Artificial Sequence
  Synthetic Oligonucleotide
aaacggcacattcaactggc

SEQ ID NO: 538 - DNA, 23 bp, Artificial Sequence
  Synthetic Oligonucleotide
taaaaaacgaacgataaccgtga

SEQ ID NO: 539 - DNA, 20 bp, Artificial Sequence
  Synthetic Oligonucleotide
gcacaacactgcctgaaaca

SEQ ID NO: 540 - DNA, 20 bp, Artificial Sequence
  Synthetic Oligonucleotide
gatgaacacgcggacgagta

SEQ ID NO: 541 - DNA, 23 bp, Artificial Sequence
  Synthetic oligonucleotide
gagactgttgataaaacgtaaaa

SEQ ID NO: 542 - DNA, 20 bp, Artificial Sequence
  Synthetic Oligonucleotide
catcagcattcctggccgta

SEQ ID NO: 543 - DNA, 20 bp, Artificial Sequence
  Synthetic Oligonucleotide
acgcccgtgacagtaaacat

SEQ ID NO: 544 - DNA, 23 bp, Artificial Sequence
  Synthetic Oligonucleotide
agatgttattttttactcacaac

SEQ ID NO: 545 - DNA, 20 bp, Artificial Sequence
  Synthetic Oligonucleotide
cgggtgaatagagggcgttt

SEQ ID NO: 546 - DNA, 20 bp, Artificial Sequence
  Synthetic Oligonucleotide
tcaggcacgcacttatagca

SEQ ID NO: 547 - DNA, 23 bp, Artificial Sequence
  Synthetic Oligonucleotide
gttctgtacactttgttttgtca

SEQ ID NO: 548 - DNA, 20 bp, Artificial Sequence
  Synthetic Oligonucleotide
gctcgacgcatcttcctcat

SEQ ID NO: 549 - DNA, 20 bp, Artificial Sequence
  Synthetic Oligonucleotide
ggacagagccgacagaacaa

SEQ ID NO: 550 - DNA, 23 bp, Artificial Sequence
  Synthetic Oligonucleotide
aagtttggtagattttagtttgt

SEQ ID NO: 551 - DNA, 20 bp, Artificial Sequence
  Synthetic Oligonucleotide
acacaggtttatccccgctg

SEQ ID NO: 552 - DNA, 20 bp, Artificial Sequence
  Synthetic Oligonucleotide
cgcctctgaaaactcctcca

SEQ ID NO: 553 - DNA, 23 bp, Artificial Sequence
  Synthetic Oligonucleotide
ttaatgaaaccttcttgacgctg

SEQ ID NO: 554 - DNA, 20 bp, Artificial Sequence
  Synthetic Oligonucleotide
ctggcgctcatcaacaatcg

SEQ ID NO: 555 - DNA, 20 bp, Artificial Sequence
  Synthetic Oligonucleotide
caattttgccttccccgagc

SEQ ID NO: 556 - DNA, 23 bp, Artificial Sequence
  Synthetic Oligonucleotide
tagcttatattgtggtcattagc

SEQ ID NO: 557 - DNA, 20 bp, Artificial Sequence
  Synthetic Oligonucleotide
cgaccgacgattatcccctg

SEQ ID NO: 558 - DNA, 20 bp, Artificial Sequence
  Synthetic Oligonucleotide
agcacgagggtcagcaatac

SEQ ID NO: 559 - DNA, 23 bp, Artificial Sequence
  Synthetic Oligonucleotide
accacctcaagctatgccgccag

SEQ ID NO: 560 - DNA, 20 bp, Artificial Sequence
  Synthetic Oligonucleotide
ttggtaggcctgataagcgc

SEQ ID NO: 561 - DNA, 20 bp, Artificial Sequence
  Synthetic Oligonucleotide
gtagcagatgacctcgcctc

SEQ ID NO: 562 - DNA, 23 bp, Artificial Sequence
  Synthetic Oligonucleotide
tattcatcgtgttgataagatat

SEQ ID NO: 563 - DNA, 20 bp, Artificial Sequence
  Synthetic Oligonucleotide
tgtgatgttctacgggcagg

SEQ ID NO: 564 - DNA, 20 bp, Artificial Sequence
  Synthetic Oligonucleotide
ctcagcgatcacccgaaact

SEQ ID NO: 565 - DNA, 23 bp, Artificial Sequence
  Synthetic Oligonucleotide
tttacttgctcatcgttataatt

SEQ ID NO: 566 - DNA, 20 bp, Artificial Sequence
  Synthetic Oligonucleotide
ttaaaccgtgggaaggaggc

SEQ ID NO: 567 - DNA, 20 bp, Artificial Sequence
  Synthetic Oligonucleotide
ttttgcgaggcgttttccag

SEQ ID NO: 568 - DNA, 23 bp, Artificial Sequence
  Synthetic Oligonucleotide
aaaactgcttcatagcgcggatt

SEQ ID NO: 569 - DNA, 20 bp, Artificial Sequence
  Synthetic Oligonucleotide
gcagtataaaaagcgcgcca

SEQ ID NO: 570 - DNA, 20 bp, Artificial Sequence
  Synthetic Oligonucleotide
gctgttgattgacgccagtg

SEQ ID NO: 571 - DNA, 23 bp, Artificial Sequence
  Synthetic Oligonucleotide
ttttatacctgtagatcatcata

SEQ ID NO: 572 - DNA, 20 bp, Artificial Sequence
  Synthetic Oligonucleotide
caggtgtcaggtcggaaaca

SEQ ID NO: 573 - DNA, 20 bp, Artificial Sequence
  Synthetic Oligonucleotide
gccgatagtgttccttgcct

SEQ ID NO: 574 - DNA, 23 bp, Artificial Sequence
  Synthetic Oligonucleotide
ctcttcggacttcgcgggacaaa

SEQ ID NO: 575 - DNA, 20 bp, Artificial Sequence
  Synthetic Oligonucleotide
tttgttagtggcgtgtccgt

SEQ ID NO: 576 - DNA, 20 bp, Artificial Sequence
  Synthetic Oligonucleotide
tttggcggctttgatttccg

SEQ ID NO: 577 - DNA, 23 bp, Artificial Sequence
  Synthetic Oligonucleotide
tgagttatttttgtagggctata

SEQ ID NO: 578 - DNA, 20 bp, Artificial Sequence
  Synthetic Oligonucleotide
agtttgcggggtgatgagag

SEQ ID NO: 579 - DNA, 20 bp, Artificial Sequence
  Synthetic Oligonucleotide
aatgacacacaagaccagct

SEQ ID NO: 580 - DNA, 23 bp, Artificial Sequence
  Synthetic Oligonucleotide
acgccgtgaaaagacgggcttac

SEQ ID NO: 581 - DNA, 20 bp, Artificial Sequence
  Synthetic Oligonucleotide
ggtcagccgattttgcatcc

SEQ ID NO: 582 - DNA, 20 bp, Artificial Sequence
  Synthetic Oligonucleotide
gaaatgtcttcaggcgtggc

SEQ ID NO: 583 - DNA, 23 bp, Artificial Sequence
  Synthetic Oligonucleotide
accagttcagaagctgctatcag

SEQ ID NO: 584 - DNA, 20 bp, Artificial Sequence
  Synthetic Oligonucleotide
tcatggcattgctgacgact

SEQ ID NO: 585 - DNA, 20 bp, Artificial Sequence
  Synthetic Oligonucleotide
ctgtctgtgcgctatgccta

SEQ ID NO: 586 - DNA, 23 bp, Artificial Sequence
  Synthetic Oligonucleotide
ttgttaaaaaatgtgaatcactt

SEQ ID NO: 587 - DNA, 20 bp, Artificial Sequence
  Synthetic Oligonucleotide
gttcttcagcaggcgggata

SEQ ID NO: 588 - DNA, 20 bp, Artificial Sequence
  Synthetic Oligonucleotide
gatgacgagtggtactccgc

SEQ ID NO: 589 - DNA, 23 bp, Artificial Sequence
  Synthetic Oligonucleotide
gtctgcgatcctgccagcaaata

SEQ ID NO: 590 - DNA, 20 bp, Artificial Sequence
  Synthetic Oligonucleotide
ggagaggctttcccgtttca

SEQ ID NO: 591 - DNA, 20 bp, Artificial Sequence
  Synthetic Oligonucleotide
tagactgcttgcatggcgaa

SEQ ID NO: 592 - DNA, 23 bp, Artificial Sequence
  Synthetic Oligonucleotide
attttggtgagacccaaaatcga

SEQ ID NO: 593 - DNA, 20 bp, Artificial Sequence
  Synthetic Oligonucleotide
gctccacttttccacgacca

SEQ ID NO: 594 - DNA, 20 bp, Artificial Sequence
  Synthetic Oligonucleotide
gtggtctgatccagcgttga

SEQ ID NO: 595 - DNA, 23 bp, Artificial Sequence
  Synthetic Oligonucleotide
gatattgtgatacacattgaggt

SEQ ID NO: 596 - DNA, 21 bp, Artificial Sequence
  Synthetic Oligonucleotide
tgtggcgaagttgagatacca

SEQ ID NO: 597 - DNA, 22 bp, Artificial Sequence
  Synthetic Oligonucleotide
actatctgaactcttcgtggct

SEQ ID NO: 598 - DNA, 23 bp, Artificial Sequence
  Synthetic Oligonucleotide
agaaggttagcatcaaatgataa

SEQ ID NO: 599 - DNA, 20 bp, Artificial Sequence
  Synthetic Oligonucleotide
gcattctgcgggaagggata

SEQ ID NO: 600 - DNA, 20 bp, Artificial Sequence
  Synthetic Oligonucleotide
ttttgcagcatcctggcaac

SEQ ID NO: 601 - DNA, 23 bp, Artificial Sequence
  Synthetic Oligonucleotide
gatggaaaggtgattgaaaactc

SEQ ID NO: 602 - DNA, 20 bp, Artificial Sequence
  Synthetic Oligonucleotide
aaccagcgttgaccatttgc

SEQ ID NO: 603 - DNA, 20 bp, Artificial Sequence
  Synthetic Oligonucleotide
ataacttccagtgggcgtgg

SEQ ID NO: 604 - DNA, 23 bp, Artificial Sequence
  Synthetic Oligonucleotide
ttacccctgttacacgggaagtg

SEQ ID NO: 605 - DNA, 20 bp, Artificial Sequence
  Synthetic Oligonucleotide
agtagttctgacaacgggcg

SEQ ID NO: 606 - DNA, 20 bp, Artificial Sequence
  Synthetic Oligonucleotide
caactccgctggcagaaaag

SEQ ID NO: 607 - DNA, 23 bp, Artificial Sequence
  Synthetic Oligonucleotide
aatgggtggtttttgttgtgtaa

SEQ ID NO: 608 - DNA, 20 bp, Artificial Sequence
  Synthetic Oligonucleotide
caaattatacggtgcgcccc

SEQ ID NO: 609 - DNA, 20 bp, Artificial Sequence
  Synthetic Oligonucleotide
tcggcgctaagaaccatcat

SEQ ID NO: 610 - DNA, 23 bp, Artificial Sequence
  Synthetic Oligonucleotide
ttgtcagatattacgcctgtgtg

SEQ ID NO: 611 - DNA, 20 bp, Artificial Sequence
  Synthetic Oligonucleotide
tatccacccgtgcgattacg

SEQ ID NO: 612 - DNA, 20 bp, Artificial Sequence
  Synthetic Oligonucleotide
ccagaatgacctcggcaact

SEQ ID NO: 613 - DNA, 23 bp, Artificial Sequence
  Synthetic Oligonucleotide
actatagactatccgggcaatgt

SEQ ID NO: 614 - DNA, 20 bp, Artificial Sequence
  Synthetic Oligonucleotide
tgagtgccagaatcttgcgt

SEQ ID NO: 615 - DNA, 20 bp, Artificial Sequence
  Synthetic Oligonucleotide
acgtacttcgccacctgaag

SEQ ID NO: 616 - DNA, 23 bp, Artificial Sequence
  Synthetic Oligonucleotide
attttgtgatctgtttaaatgtt

SEQ ID NO: 617 - DNA, 20 bp, Artificial Sequence
  Synthetic Oligonucleotide
gagcgaaaacagcagccatc

SEQ ID NO: 618 - DNA, 20 bp, Artificial Sequence
  Synthetic Oligonucleotide
gtcatgattggcctgcgttc

SEQ ID NO: 619 - DNA, 23 bp, Artificial Sequence
  Synthetic Oligonucleotide
tctgtaaatcacgacaatgggtg

SEQ ID NO: 620 - DNA, 20 bp, Artificial Sequence
  Synthetic Oligonucleotide
agtcggtgaatgagccactg

SEQ ID NO: 621 - DNA, 20 bp, Artificial Sequence
  Synthetic Oligonucleotide
gcagttggggtaagtcgtca

SEQ ID NO: 622 - DNA, 23 bp, Artificial Sequence
  Synthetic Oligonucleotide
actgcccgtttcgagagtttctc

SEQ ID NO: 623 - DNA, 20 bp, Artificial Sequence
  Synthetic Oligonucleotide
gcaggctcggttagggtaag

SEQ ID NO: 624 - DNA, 20 bp, Artificial Sequence
  Synthetic Oligonucleotide
ggctaacgtggcaggaatct

SEQ ID NO: 625 - DNA, 23 bp, Artificial Sequence
  Synthetic Oligonucleotide
ggccggacaagacgtttatcgca

SEQ ID NO: 626 - DNA, 20 bp, Artificial Sequence
  Synthetic Oligonucleotide
tgtaggcctgataagacgcg

SEQ ID NO: 627 - DNA, 20 bp, Artificial Sequence
  Synthetic Oligonucleotide
tgaaggggtacgagtcgaca

SEQ ID NO: 628 - DNA, 23 bp, Artificial Sequence
  Synthetic Oligonucleotide
gtgctgataggcagattcgaact

SEQ ID NO: 629 - DNA, 20 bp, Artificial Sequence
  Synthetic Oligonucleotide
aggtagccgagttccaggat

SEQ ID NO: 630 - DNA, 20 bp, Artificial Sequence
  Synthetic Oligonucleotide
tacggtagtgattgcagcgg

SEQ ID NO: 631 - DNA, 23 bp, Artificial Sequence
  Synthetic Oligonucleotide
ggtggctctggctggagtgagag

SEQ ID NO: 632 - DNA, 20 bp, Artificial Sequence
  Synthetic Oligonucleotide
cctccgccagctgaagaaat

SEQ ID NO: 633 - DNA, 20 bp, Artificial Sequence
  Synthetic Oligonucleotide
ccagacgggtttcatcagca

SEQ ID NO: 634 - DNA, 23 bp, Artificial Sequence
  Synthetic Oligonucleotide
atagcgatcccttgctgaaaata

SEQ ID NO: 635 - DNA, 20 bp, Artificial Sequence
  Synthetic Oligonucleotide
gtcaggtagccagaacaccc

SEQ ID NO: 636 - DNA, 20 bp, Artificial Sequence
  Synthetic Oligonucleotide
gccgggatacgttccttctt

SEQ ID NO: 637 - DNA, 33 bp, Artificial Sequence
  Synthetic Oligonucleotide
ctgtcgtcggtgacagattaatgtcattgtgac

SEQ ID NO: 638 - DNA, 29 bp, Artificial Sequence
  Synthetic Oligonucleotide
tgggcagcgcccacatacgcagcgatttc

SEQ ID NO: 639 - DNA, 31 bp, Artificial Sequence; identical to SEQ ID NO: 483
  Synthetic Oligonucleotide

SEQ ID NO: 640 - RNA, 81 nt, Artificial Sequence; identical to SEQ ID NO: 4
  Synthetic Oligonucleotide

SEQ ID NO: 641 - RNA, 89 nt, Artificial Sequence; identical to SEQ ID NO: 3
  Synthetic Oligonucleotide

SEQ ID NO: 642 - RNA, 115 nt, Artificial Sequence; identical to SEQ ID NO: 2
  Synthetic Oligonucleotide

SEQ ID NO: 643 - RNA, 144 nt, Artificial Sequence; identical to SEQ ID NO: 1
  Synthetic Oligonucleotide

SEQ ID NO: 644 - RNA, 169 nt, Artificial Sequence; identical to SEQ ID NO: 469
  Synthetic Oligonucleotide

SEQ ID NO: 645 - RNA, 215 nt, Artificial Sequence; identical to SEQ ID NO: 468
  Synthetic Oligonucleotide

SEQ ID NO: 646 - RNA, 258 nt, Artificial Sequence; identical to SEQ ID NO: 490
  Synthetic Oligonucleotide
  misc_feature (236)..(258): n is a, c, g, or u

SEQ ID NO: 647 - RNA, 253 nt, Artificial Sequence; identical to SEQ ID NO: 491
  Synthetic Oligonucleotide
  misc_feature (231)..(253): n is a, c, g, or u

SEQ ID NO: 648 - RNA, 38 nt, Artificial Sequence; identical to SEQ ID NO: 492
  Synthetic Oligonucleotide
  misc_feature (16)..(38): n is a, c, g, or u

SEQ ID NO: 649 - DNA, 23 bp, Artificial Sequence
  Synthetic Oligonucleotide
tcagaaggttagcatcaaatgat

SEQ ID NO: 650 - DNA, 20 bp, Artificial Sequence
  Synthetic Oligonucleotide
agataaccgggcacgttttt

SEQ ID NO: 651 - DNA, 20 bp, Artificial Sequence
  Synthetic Oligonucleotide
ttcctccacatccactgtct

SEQ ID NO: 652 - DNA, 23 bp, Artificial Sequence
  Synthetic Oligonucleotide
tgtgaagtaataccctaaccacc

SEQ ID NO: 653 - DNA, 20 bp, Artificial Sequence
  Synthetic Oligonucleotide
gagccggtgtggaatggtaa

SEQ ID NO: 654 - DNA, 20 bp, Artificial Sequence
  Synthetic Oligonucleotide
attctggcgcttgctacctt

SEQ ID NO: 655 - DNA, 23 bp, Artificial Sequence
  Synthetic Oligonucleotide
ttacatgtcctgtacccggcaga

SEQ ID NO: 656 - DNA, 20 bp, Artificial Sequence
  Synthetic Oligonucleotide
acgaaaggcaggtgagaagg

SEQ ID NO: 657 - DNA, 20 bp, Artificial Sequence
  Synthetic Oligonucleotide
accattctcacccggcaatt

SEQ ID NO: 658 - DNA, 23 bp, Artificial Sequence
  Synthetic Oligonucleotide
atagtgaatccgcttattctcag

SEQ ID NO: 659 - DNA, 20 bp, Artificial Sequence
  Synthetic Oligonucleotide
acgttcgaaaggcgtaccaa

SEQ ID NO: 660 - DNA, 20 bp, Artificial Sequence
  Synthetic Oligonucleotide
tgagtgccattgtagtgcga

SEQ ID NO: 661 - DNA, 23 bp, Artificial Sequence
  Synthetic Oligonucleotide
ggattcacacaacgaaacaatta

SEQ ID NO: 662 - DNA, 20 bp, Artificial Sequence
  Synthetic Oligonucleotide
caggatccaggattcacggg

SEQ ID NO: 663 - DNA, 20 bp, Artificial Sequence
  Synthetic Oligonucleotide
aaccgggtattccacacacc

SEQ ID NO: 664 - DNA, 23 bp, Artificial Sequence
  Synthetic Oligonucleotide
tattgcgaagggagggtgacgaa

SEQ ID NO: 665 - DNA, 20 bp, Artificial Sequence
  Synthetic Oligonucleotide
ttggtagacgcgctagcttc

SEQ ID NO: 666 - DNA, 20 bp, Artificial Sequence
  Synthetic Oligonucleotide
tcggtttcgccatcacatga

SEQ ID NO: 667 - DNA, 23 bp, Artificial Sequence
  Synthetic Oligonucleotide
ctgtgccaaaagcggaagttgga

SEQ ID NO: 668 - DNA, 20 bp, Artificial Sequence
  Synthetic Oligonucleotide
agccagaaatatgccgagcc

SEQ ID NO: 669 - DNA, 20 bp, Artificial Sequence
  Synthetic Oligonucleotide
ggcagaccagaaagcgtttg

SEQ ID NO: 670 - DNA, 23 bp, Artificial Sequence
  Synthetic Oligonucleotide
ctgtaacgtaatcattaacatgc

SEQ ID NO: 671 - DNA, 20 bp, Artificial Sequence
  Synthetic Oligonucleotide
gcggccgccaattttagttt

SEQ ID NO: 672 - DNA, 20 bp, Artificial Sequence
  Synthetic Oligonucleotide
gctcggcatatttgtctgcg

SEQ ID NO: 673 - DNA, 23 bp, Artificial Sequence
  Synthetic Oligonucleotide
tcagacctatttggccggtaatc

SEQ ID NO: 674 - DNA, 20 bp, Artificial Sequence
  Synthetic Oligonucleotide
cagattgccgcggctttaat

SEQ ID NO: 675 - DNA, 20 bp, Artificial Sequence
  Synthetic Oligonucleotide
gtcccagtccgatctcttgc

SEQ ID NO: 676 - DNA, 23 bp, Artificial Sequence
  Synthetic Oligonucleotide
atgccggtcattccggggttttg

SEQ ID NO: 677 - DNA, 20 bp, Artificial Sequence
  Synthetic Oligonucleotide
cgtttcgttttccggtgctt

SEQ ID NO: 678 - DNA, 20 bp, Artificial Sequence
  Synthetic Oligonucleotide
aagaagcctcaccacaaccc

SEQ ID NO: 679 - DNA, 23 bp, Artificial Sequence
  Synthetic Oligonucleotide
ttaggataattggaatgaatatc

SEQ ID NO: 680 - DNA, 20 bp, Artificial Sequence
  Synthetic Oligonucleotide
cgcgtcttatcaggcctaca

SEQ ID NO: 681 - DNA, 20 bp, Artificial Sequence
  Synthetic Oligonucleotide
acccaaaaacatttcgggcg

SEQ ID NO: 682 - DNA, 23 bp, Artificial Sequence
  Synthetic Oligonucleotide
ttcaaaagagtataaatgcctga

SEQ ID NO: 683 - DNA, 20 bp, Artificial Sequence
  Synthetic Oligonucleotide
tgggttgaacataacgccga

SEQ ID NO: 684 - DNA, 20 bp, Artificial Sequence
  Synthetic Oligonucleotide
gcaagtaagcccgcaatagc

SEQ ID NO: 685 - DNA, 23 bp, Artificial Sequence
  Synthetic Oligonucleotide
tttgcggcattaacgctcaccag

SEQ ID NO: 686 - DNA, 20 bp, Artificial Sequence
  Synthetic Oligonucleotide
gaacggcctcagtagtctcg

SEQ ID NO: 687 - DNA, 20 bp, Artificial Sequence
  Synthetic Oligonucleotide
tgtttagagtgttccccgcg

SEQ ID NO: 688 - DNA, 23 bp, Artificial Sequence
  Synthetic Oligonucleotide
accctcttaaactatcccactaa

SEQ ID NO: 689 - DNA, 20 bp, Artificial Sequence
  Synthetic Oligonucleotide
aaggctgggaaatcagacgg

SEQ ID NO: 690 - DNA, 20 bp, Artificial Sequence
  Synthetic Oligonucleotide
tatctgcaaagtcgctgggg

SEQ ID NO: 691 - DNA, 23 bp, Artificial Sequence
  Synthetic Oligonucleotide
aacctcactactatcgaagactc

SEQ ID NO: 692 - DNA, 20 bp, Artificial Sequence
  Synthetic Oligonucleotide
cgattggcattaacccgctt

SEQ ID NO: 693 - DNA, 20 bp, Artificial Sequence
  Synthetic Oligonucleotide
aaacggcacattcaactggc

SEQ ID NO: 694 - DNA, 23 bp, Artificial Sequence
  Synthetic Oligonucleotide
taaaaaacgaacgataaccgtga

SEQ ID NO: 695 - DNA, 20 bp, Artificial Sequence
  Synthetic Oligonucleotide
gcacaacactgcctgaaaca

SEQ ID NO: 696 - DNA, 20 bp, Artificial Sequence
  Synthetic Oligonucleotide
gatgaacacgcggacgagta

SEQ ID NO: 697 - DNA, 23 bp, Artificial Sequence
  Synthetic Oligonucleotide
gagactgttgataaaacgtaaaa

SEQ ID NO: 698 - DNA, 20 bp, Artificial Sequence
  Synthetic Oligonucleotide
catcagcattcctggccgta

SEQ ID NO: 699 - DNA, 20 bp, Artificial Sequence
  Synthetic Oligonucleotide
acgcccgtgacagtaaacat

SEQ ID NO: 700 - DNA, 23 bp, Artificial Sequence
  Synthetic Oligonucleotide
agatgttattttttactcacaac

SEQ ID NO: 701 - DNA, 20 bp, Artificial Sequence
  Synthetic Oligonucleotide
cgggtgaatagagggcgttt

SEQ ID NO: 702 - DNA, 20 bp, Artificial Sequence
  Synthetic Oligonucleotide
tcaggcacgcacttatagca

SEQ ID NO: 703 - DNA, 23 bp, Artificial Sequence
  Synthetic Oligonucleotide
gttctgtacactttgttttgtca

SEQ ID NO: 704 - DNA, 20 bp, Artificial Sequence
  Artificial Sequence
gctcgacgcatcttcctcat

SEQ ID NO: 705 - DNA, 20 bp, Artificial Sequence
  Synthetic Oligonucleotide
ggacagagccgacagaacaa

SEQ ID NO: 706 - DNA, 23 bp, Artificial Sequence
  Synthetic Oligonucleotide
aagtttggtagattttagtttgt

SEQ ID NO: 707 - DNA, 20 bp, Artificial Sequence
  Synthetic Oligonucleotide
acacaggtttatccccgctg

SEQ ID NO: 708 - DNA, 20 bp, Artificial Sequence
  Synthetic Oligonucleotide
cgcctctgaaaactcctcca

SEQ ID NO: 709 - DNA, 23 bp, Artificial Sequence
  Synthetic Oligonucleotide
ttaatgaaaccttcttgacgctg

SEQ ID NO: 710 - DNA, 20 bp, Artificial Sequence
  Synthetic Oligonucleotide
ctggcgctcatcaacaatcg

SEQ ID NO: 711 - DNA, 20 bp, Artificial Sequence
  Synthetic Oligonucleotide
caattttgccttccccgagc

SEQ ID NO: 712 - DNA, 23 bp, Artificial Sequence
  Synthetic Oligonucleotide
tagcttatattgtggtcattagc

SEQ ID NO: 713 - DNA, 20 bp, Artificial Sequence
  Synthetic Oligonucleotide
cgaccgacgattatcccctg

SEQ ID NO: 714 - DNA, 20 bp, Artificial Sequence
  Synthetic Oligonucleotide
agcacgagggtcagcaatac

SEQ ID NO: 715 - DNA, 23 bp, Artificial Sequence
  Synthetic Oligonucleotide
accacctcaagctatgccgccag

SEQ ID NO: 716 - DNA, 20 bp, Artificial Sequence
  Synthetic Oligonucleotide
ttggtaggcctgataagcgc

SEQ ID NO: 717 - DNA, 20 bp, Artificial Sequence
  Synthetic Oligonucleotide
gtagcagatgacctcgcctc

SEQ ID NO: 718 - DNA, 27 bp, Artificial Sequence
  Synthetic Oligonucleotide
tgtctattcatcgtgttgataagatat

SEQ ID NO: 719 - DNA, 20 bp, Artificial Sequence
  Synthetic Oligonucleotide
tgtgatgttctacgggcagg

SEQ ID NO: 720 - DNA, 20 bp, Artificial Sequence
  Synthetic Oligonucleotide
ctcagcgatcacccgaaact

SEQ ID NO: 721 - DNA, 23 bp, Artificial Sequence
  Synthetic Oligonucleotide
tttacttgctcatcgttataatt

SEQ ID NO: 722 - DNA, 20 bp, Artificial Sequence
  Synthetic Oligonucleotide
ttaaaccgtgggaaggaggc

SEQ ID NO: 723 - DNA, 20 bp, Artificial Sequence
  Synthetic Oligonucleotide
ttttgcgaggcgttttccag

SEQ ID NO: 724 - DNA, 23 bp, Artificial Sequence
  Synthetic Oligonucleotide
aaaactgcttcatagcgcggatt

SEQ ID NO: 725 - DNA, 20 bp, Artificial Sequence
  Synthetic Oligonucleotide
gcagtataaaaagcgcgcca

SEQ ID NO: 726 - DNA, 20 bp, Artificial Sequence
  Synthetic Oligonucleotide
gctgttgattgacgccagtg

SEQ ID NO: 727 - DNA, 23 bp, Artificial Sequence
  Synthetic Oligonucleotide
ttttatacctgtagatcatcata

SEQ ID NO: 728 - DNA, 20 bp, Artificial Sequence
  Synthetic Oligonucleotide
caggtgtcaggtcggaaaca

SEQ ID NO: 729 - DNA, 20 bp, Artificial Sequence
  Synthetic Oligonucleotide
gccgatagtgttccttgcct

SEQ ID NO: 730 - DNA, 23 bp, Artificial Sequence
  Synthetic Oligonucleotide
ctcttcggacttcgcgggacaaa

SEQ ID NO: 731 - DNA, 20 bp, Artificial Sequence
  Synthetic Oligonucleotide
tttgttagtggcgtgtccgt

SEQ ID NO: 732 - DNA, 20 bp, Artificial Sequence
  Synthetic Oligonucleotide
tttggcggctttgatttccg

SEQ ID NO: 733 - DNA, 23 bp, Artificial Sequence
  Synthetic Oligonucleotide
tgagttatttttgtagggctata

SEQ ID NO: 734 - DNA, 20 bp, Artificial Sequence
  Synthetic Oligonucleotide
agtttgcggggtgatgagag

SEQ ID NO: 735 - DNA, 20 bp, Artificial Sequence
  Synthetic Oligonucleotide
aatgacacacaagaccagct

SEQ ID NO: 736 - DNA, 23 bp, Artificial Sequence
  Synthetic Oligonucleotide
acgccgtgaaaagacgggcttac

SEQ ID NO: 737 - DNA, 20 bp, Artificial Sequence
  Synthetic Oligonucleotide
ggtcagccgattttgcatcc

SEQ ID NO: 738 - DNA, 20 bp, Artificial Sequence
  Synthetic Oligonucleotide
gaaatgtcttcaggcgtggc

SEQ ID NO: 739 - DNA, 23 bp, Artificial Sequence
  Synthetic Oligonucleotide
accagttcagaagctgctatcag

SEQ ID NO: 740 - DNA, 20 bp, Artificial Sequence
  Synthetic Oligonucleotide
tcatggcattgctgacgact

SEQ ID NO: 741 - DNA, 20 bp, Artificial Sequence
  Synthetic Oligonucleotide
ctgtctgtgcgctatgccta

SEQ ID NO: 742 - DNA, 23 bp, Artificial Sequence
  Synthetic Oligonucleotide
ttgttaaaaaatgtgaatcactt

SEQ ID NO: 743 - DNA, 20 bp, Artificial Sequence
  Synthetic Oligonucleotide
gttcttcagcaggcgggata

SEQ ID NO: 744 - DNA, 20 bp, Artificial Sequence
  Synthetic Oligonucleotide
gatgacgagtggtactccgc

SEQ ID NO: 745 - DNA, 23 bp, Artificial Sequence
  Synthetic Oligonucleotide
gtctgcgatcctgccagcaaata

SEQ ID NO: 746 - DNA, 20 bp, Artificial Sequence
  Synthetic Oligonucleotide
ggagaggctttcccgtttca

SEQ ID NO: 747 - DNA, 20 bp, Artificial Sequence
  Synthetic Oligonucleotide
tagactgcttgcatggcgaa

SEQ ID NO: 748 - DNA, 23 bp, Artificial Sequence
  Synthetic Oligonucleotide
attttggtgagacccaaaatcga

SEQ ID NO: 749 - DNA, 20 bp, Artificial Sequence
  Synthetic Oligonucleotide
gctccacttttccacgacca

SEQ ID NO: 750 - DNA, 20 bp, Artificial Sequence
  Synthetic Oligonucleotide
gtggtctgatccagcgttga

SEQ ID NO: 751 - DNA, 23 bp, Artificial Sequence
  Synthetic Oligonucleotide
gatattgtgatacacattgaggt

SEQ ID NO: 752 - DNA, 21 bp, Artificial Sequence
  Synthetic Oligonucleotide
tgtggcgaagttgagatacca

SEQ ID NO: 753 - DNA, 22 bp, Artificial Sequence
  Synthetic Oligonucleotide
actatctgaactcttcgtggct

SEQ ID NO: 754 - DNA, 23 bp, Artificial Sequence
  Synthetic Oligonucleotide
agaaggttagcatcaaatgataa

SEQ ID NO: 755 - DNA, 20 bp, Artificial Sequence
  Synthetic Oligonucleotide
gcattctgcgggaagggata

SEQ ID NO: 756 - DNA, 20 bp, Artificial Sequence
  Synthetic Oligonucleotide
ttttgcagcatcctggcaac

SEQ ID NO: 757 - DNA, 23 bp, Artificial Sequence
  Synthetic Oligonucleotide
gatggaaaggtgattgaaaactc

SEQ ID NO: 758 - DNA, 20 bp, Artificial Sequence
  Synthetic Oligonucleotide
aaccagcgttgaccatttgc

SEQ ID NO: 759 - DNA, 20 bp, Artificial Sequence
  Synthetic Oligonucleotide
ataacttccagtgggcgtgg

SEQ ID NO: 760 - DNA, 23 bp, Artificial Sequence
  Synthetic Oligonucleotide
ttacccctgttacacgggaagtg

SEQ ID NO: 761 - DNA, 20 bp, Artificial Sequence
  Synthetic Oligonucleotide
agtagttctgacaacgggcg

SEQ ID NO: 762 - DNA, 20 bp, Artificial Sequence
  Synthetic Oligonucleotide
caactccgctggcagaaaag

SEQ ID NO: 763 - DNA, 23 bp, Artificial Sequence
  Synthetic Oligonucleotide
aatgggtggtttttgttgtgtaa

SEQ ID NO: 764 - DNA, 20 bp, Artificial Sequence
  Synthetic Oligonucleotide
caaattatacggtgcgcccc

SEQ ID NO: 765 - DNA, 20 bp, Artificial Sequence
  Synthetic Oligonucleotide
tcggcgctaagaaccatcat

SEQ ID NO: 766 - DNA, 23 bp, Artificial Sequence
  Synthetic Oligonucleotide
ttgtcagatattacgcctgtgtg

SEQ ID NO: 767 - DNA, 20 bp, Artificial Sequence
  Synthetic Oligonucleotide
tatccacccgtgcgattacg

SEQ ID NO: 768 - DNA, 20 bp, Artificial Sequence
  Synthetic Oligonucleotide
ccagaatgacctcggcaact

SEQ ID NO: 769 - DNA, 23 bp, Artificial Sequence
  Synthetic Oligonucleotide
actatagactatccgggcaatgt

SEQ ID NO: 770 - DNA, 20 bp, Artificial Sequence
  Synthetic Oligonucleotide
tgagtgccagaatcttgcgt

SEQ ID NO: 771 - DNA, 20 bp, Artificial Sequence
  Synthetic Oligonucleotide
acgtacttcgccacctgaag

SEQ ID NO: 772 - DNA, 23 bp, Artificial Sequence
  Synthetic Oligonucleotide
attttgtgatctgtttaaatgtt

SEQ ID NO: 773 - DNA, 20 bp, Artificial Sequence
  Synthetic Oligonucleotide
gagcgaaaacagcagccatc

SEQ ID NO: 774 - DNA, 20 bp, Artificial Sequence
  Synthetic Oligonucleotide
gtcatgattggcctgcgttc

SEQ ID NO: 775 - DNA, 23 bp, Artificial Sequence
  Synthetic Oligonucleotide
tctgtaaatcacgacaatgggtg

SEQ ID NO: 776 - DNA, 20 bp, Artificial Sequence
  Synthetic Oligonucleotide
agtcggtgaatgagccactg

SEQ ID NO: 777 - DNA, 20 bp, Artificial Sequence
  Synthetic Oligonucleotide
gcagttggggtaagtcgtca

SEQ ID NO: 778 - DNA, 23 bp, Artificial Sequence
  Synthetic Oligonucleotide
actgcccgtttcgagagtttctc

SEQ ID NO: 779 - DNA, 20 bp, Artificial Sequence
  Synthetic Oligonucleotide
gcaggctcggttagggtaag

SEQ ID NO: 780 - DNA, 20 bp, Artificial Sequence
  Synthetic Oligonucleotide
ggctaacgtggcaggaatct

SEQ ID NO: 781 - DNA, 23 bp, Artificial Sequence
  Synthetic Oligonucleotide
ggccggacaagacgtttatcgca

SEQ ID NO: 782 - DNA, 20 bp, Artificial Sequence
  Synthetic Oligonucleotide
tgtaggcctgataagacgcg

SEQ ID NO: 783 - DNA, 20 bp, Artificial Sequence
  Synthetic Oligonucleotide
tgaaggggtacgagtcgaca

SEQ ID NO: 784 - DNA, 23 bp, Artificial Sequence
  Synthetic Oligonucleotide
gtgctgataggcagattcgaact

SEQ ID NO: 785 - DNA, 20 bp, Artificial Sequence
  Synthetic Oligonucleotide
aggtagccgagttccaggat

SEQ ID NO: 786 - DNA, 20 bp, Artificial Sequence
  Synthetic Oligonucleotide
tacggtagtgattgcagcgg

SEQ ID NO: 787 - DNA, 23 bp, Artificial Sequence
  Synthetic Oligonucleotide
ggtggctctggctggagtgagag

SEQ ID NO: 788 - DNA, 20 bp, Artificial Sequence
  Synthetic Oligonucleotide
cctccgccagctgaagaaat

SEQ ID NO: 789 - DNA, 20 bp, Artificial Sequence
  Synthetic Oligonucleotide
ccagacgggtttcatcagca

SEQ ID NO: 790 - DNA, 23 bp, Artificial Sequence
  Synthetic Oligonucleotide
atagcgatcccttgctgaaaata

SEQ ID NO: 791 - DNA, 20 bp, Artificial Sequence
  Synthetic Oligonucleotide
gtcaggtagccagaacaccc

SEQ ID NO: 792 - DNA, 20 bp, Artificial Sequence
  Synthetic Oligonucleotide
gccgggatacgttccttctt

SEQ ID NO: 793 - DNA, 33 bp, Artificial Sequence; identical to SEQ ID NO: 637
  Synthetic Oligonucleotide

SEQ ID NO: 794 - DNA, 29 bp, Artificial Sequence
  Synthetic Oligonucleotide
tgggcagcgcccacatacgcagcgatttc

SEQ ID NO: 795 - DNA, 25 bp, Artificial Sequence
  Synthetic Oligonucleotide
aaaacgcctaaccctaagcagattc

SEQ ID NO: 796 - DNA, 21 bp, Artificial Sequence
  Synthetic Oligonucleotide
ggtgccgaggatgacgatgag

SEQ ID NO: 797 - DNA, 20 bp, Artificial Sequence
  Synthetic Oligonucleotide
aacgctgatgggtcacgacg

SEQ ID NO: 798 - DNA, 50 bp, Artificial Sequence
  Synthetic Oligonucleotide
ctttccctacacgacgctcttccgatctcgcagaccaaaacgatctcaag

SEQ ID NO: 799 - DNA, 49 bp, Artificial Sequence
  Synthetic Oligonucleotide
ctttccctacacgacgctcttccgatctggtgccgaggatgacgatgag

SEQ ID NO: 800 - DNA, 56 bp, Artificial Sequence
  Synthetic Oligonucleotide
gactggagttcagacgtgtgctcttccgatctaatgacattaatctgtcaccgacg

SEQ ID NO: 801 - DNA, 53 bp, Artificial Sequence
  Synthetic Oligonucleotide
gactggagttcagacgtgtgctcttccgatctatgctaaaactgccaaagcgc

SEQ ID NO: 802 - DNA, 55 bp, Artificial Sequence
  Synthetic Oligonucleotide
gactggagttcagacgtgtgctcttccgatctctctgaaaaacaaccaccacgac

SEQ ID NO: 803 - DNA, 54 bp, Artificial Sequence
  Synthetic Oligonucleotide
gactggagttcagacgtgtgctcttccgatctcgcttttcgcaaattagtgtcg

SEQ ID NO: 804 - DNA, 37 bp, Artificial Sequence
  Synthetic Oligonucleotide
gtttcaacacccctcccagctagaggcgggttgaaag

SEQ ID NO: 805 - DNA, 206 bp, Artificial Sequence
  Synthetic Oligonucleotide
tgtcagtattgccaaaataatgtccgcattcactatgtaatccaattgtgttagctaaccattaacaaaataatatcgttaaaaatatcgttaaacttttcagcgtggtgtgttactgtcatacatcaaccttgccagcaagaccttacccccctatggggatttgtggttcaaagaaatgaaaattgctgtaagttgacaagttt

SEQ ID NO: 806 - DNA, 206 bp, Artificial Sequence
  Synthetic Oligonucleotide
tgtattgtactatgtaaaggacatttattttgtcaattttggtaaaaattttggctgaaaacatttttcagaagaggacagttattttgtcaatagtttaaaagaggacacttattttggcaagaagtctctagtagactattttcagactaaaataataaaacccttactgagtaagggttttaagctaagtatttttaaggaca

SEQ ID NO: 807 - DNA, 37 bp, Artificial Sequence
  Synthetic Oligonucleotide
gtttcatccaggtttgcggcaagggggcgattgaaag

SEQ ID NO: 808 - DNA, 500 bp, Artificial Sequence
  Synthetic Oligonucleotide
tttaggagcgttctcaaatttcacaactcaaatcggattgctctatgtgtagattgaaagaacagcaaattgctagcagaataaagtgttattcgacaattgttgtcgaataacactttaaatgtcgtcataacgaattgatgtcgttcagcctcaacaacttaaacttcctattaatattgactttcagctctttcagagcgatcgcgcccttgcaggacgattaacattatccatgtcgcttttcagagtagtaacaaattcagtgtcgtgttttacgatcaggggtttaacacaatcagcgtcatgattttgagatctcaatagatgacaaccagcaaaaggacaacctgacttcaaaatctacaatcagaccacaatcaaggtgcgatcgcggcaagattcccataaacctcagtttccgcatagtgtttagaaaaaatctgcttgaaaatctatttagctagaaacccagaaattctagctaaataagaattact

SEQ ID NO: 809 - DNA, 500 bp, Artificial Sequence
  Synthetic Oligonucleotide
ggtttgcggcaagggggcgattgaagagtaacttagtcttttgacaactttaataggcacaatctttcggttaacagtgggtggattgaaaggactgcctgactcggggttttaatttagaaatatttgcccctcgctataacgagcagagttagcattcgttttaactgggtagagtctgtactgtaaaatgttgaagtggataagaatttgaatgagcattcaactgcttgaagctctgatgacaagaatttgttaacgaatgatttcttacccctcgacgacaagaagctgttaaaacgacactaaattgttaacgacgacatcaatccgttaacgacgacaaataaagtgttattcgacaacaatcacacgaatttaaacaaaaaattgcctgactcttaaaagcccccagagtcaggcagtctacctgtaaggcacgcctttaaccggatacaccaaacaaacttagttgccccctagttgcttagcttttccga

SEQ ID NO: 810 - DNA, 37 bp, Artificial Sequence
  Synthetic Oligonucleotide
gtttcaacacccctcccggagtggggcgggttgaaag

SEQ ID NO: 811 - DNA, 500 bp, Artificial Sequence
  Synthetic Oligonucleotide
ttgatggctgaaagctaggaaatacgtaaattatgcgtttagcactgtcaaatggacaataattctttaaaactgacaataattatttaaagtacatattgtacattcgcacattatatgtcgcaatttgcaaacaacgacattagacgacattagcatcttgagcatctaaaacgcttatcgtataaagctttcaggaaattgttaattaaaaacgttaaattcctgacttcgcacattgtatgtcgctaacattaaagctcgcaaattaatgtcgttaatctaaattttgtcacattgcaaattcaatgtcgcattttcttcagttaatggtacattaatactaccaataactacattctcctcgcttaaatgccagacaaagaatttggattaaccggagaattgacacaaattacagaagctattttccttagtgaaagtaattttgtggtcgatccattacacattattctggaatcctcagatagccagaaact

SEQ ID NO: 812 - DNA, 500 bp, Artificial Sequence
  Synthetic Oligonucleotide
catcccggctaggggtgggttgaaagagtaagaagaatagaagtaatttcctgaaatcaactatatttggacatattttaggaatataactaaattatgggagggttgaaaggagcgctgcgatcaaacaaatgttaaggtaaaataattcgtctgtagcaaataccacagttaatgagtaagccatacgacgttaatttgcgaaaaactaatatgattgaattaacgacgcgaattagcgaaagtaatgttaattacctaaaaacgacatcaatttgcgaaaagcgacaaataatgtgcgaatgtacacatatggagaatagggaactcgaatccctgacctctgcggtgcgatcgcagcgctctaccaactgagctaattcccctgactttgttgagtgttcagttaatcacactcgtccatcatagagtattttaacattcagttagggatggctgagatttgttgccagaaaaaacttcttgtactcgctctagtt

SEQ ID NO: 813 - DNA, 37 bp, Artificial Sequence
  Synthetic Oligonucleotide
gtttcaactaccatcccgactaggggtgggttgaaag

SEQ ID NO: 814 - DNA, 500 bp, Artificial Sequence
  Synthetic Oligonucleotide
tctcctaaattcgttaacttaatctatatatcctaacttactcaaaaagtcatttaactcccctaaagtctcctctcgctgcgcttccaactcctgtacagtgacacattgtttgtcatcggtgacagattagtgtcgtcttttaaagaccttactcaataaggcttacgtccattttacactcatttgtactatttttgtttggtgacaaaataagtgtcgctttttgcttttatgacaaattaattgtcgttttttcataaagcttcaaaaataattgtgacaaattccatgtcactttttctataaatgtctgctaaaataacattatggtttttaaaatagtgttctaattatgagatgaatacttttcctaatgagcagtctaatgcaattgtactaaaaaataccattgtatcggatttgccagaaacggcacgggctaaaatggaggtcatccagacacttctagaaccctgcgatcgcacaacttacggaga

SEQ ID NO: 815 - DNA, 500 bp, Artificial Sequence
  Synthetic Oligonucleotide
gtttcaacgaccattcccaacaggggtgggtgaaatatagtctcaatattttcaatgttaagatggattgaaaggcgcacttcgttcgggaacatactatcgaagtattaaagataaatgccaatgctcagatcatgacaattaatttgtcaccagtgcttaaacgacagcaatttgtcacaaagacagttaatttgtctccacgacactaatctgtcaccgatgacaaataatatgtcactgtacaaatcgggatgacaggatttgaacctgcggccccttcgtcccgaacgaagtgcgctaccaagctgcgctacatcccgtaaaattaaacagcatttctattatagcacgatcgcccctaagactctatcccctcgcaaactttaatgaactgccgatcaagagcccctacccagaatgataagctaacagatggactaaaattcgtcagtaagctactatgactcaaggtaataataccccctatttactccgtg

SEQ ID NO: 816 - DNA, 37 bp, Artificial Sequence
  Synthetic Oligonucleotide
gtttcaactaccatcccaactaggggtgggttgaaag

SEQ ID NO: 817 - DNA, 500 bp, Artificial Sequence
  Synthetic Oligonucleotide
aattgcagtgggatgagagggttctagatagctgataggagttacaggataccactgtttagtccaggaaaagttagtcatcatcaaattaactaatttattcgactcaaatttgaaaaatgagtaaaaagcggcatttaatgtgcgaatgttgtacattcgcacattatatgtcgcttttcgcaagttaggtcgcaaccgcatttaactgctataaaccctattttacaaaggtttgatgctcttagcacatcaagcccacgaatttacttaattcgcatattccatgtcgcaaactaaatattcgcaaattgaatgtcgtttattaaaatttgtcacttcgcaaattgtttgtcgtattattgagcgattcatggtacattggtactctaatgagtgtttttgctctaatggcagacaaaaaatttgaattgacagaaaaatttacacaacttcctgaagctgtttttcttggcgagaataatttcgtaatagatcca

SEQ ID NO: 818 - DNA, 500 bp, Artificial Sequence
  Synthetic Oligonucleotide
atcagactcttaatttaagtgatagagataatatttaagcacagatatatttcttactcagcaatagcatttagtatttgcatggaaataaatagctttgagacaacattaatttgttaacgatgtctttgaggatttaggggacatcaatttgttaaaaaagacattaattttgttaacgacgacaaattatttgtaatcgactttaggacaaataatttgtcgctttatgtactttgacaaataatgtgtcgctctacatcagttaatcgacaataaccaagcgacgttaatttgcgaaaacctataatcatcaatatagtacacaaatctgtcgaaagcgacactaatttgctaataacgacactaatgtgcgaaaagcgacatttaatgtgcgaaagtacaaatgtacaaaatgggcgacctggggctcgaacccagaaccagcagattaagagtctgatgctctaccattgagctagtcgccctcaccatttact

SEQ ID NO: 819 - DNA, 37 bp, Artificial Sequence
  Synthetic Oligonucleotide
gtttcaacaaccatcccggctaggggtgggttgaaag

SEQ ID NO: 820 - DNA, 500 bp, Artificial Sequence
  Synthetic Oligonucleotide
tagctgaaagttagggaaatacgtaaattatgtcgtttagcactgtcaaattggacaataattctttaaaactgacaataatgatttaatggacatgtcgattaactaattatttgtcgtcttaacaaaataatgtcgtcaaagataaaatgtttgaaaacgttgctaaataagtgtttgcagcgttttttagtatgtcaacaatcaagaccgaatttaacattttaattgtcgtatattaaaatattcacaaattttatgtcgttttttcagatttgagttttccaaattttttggaatgtataacaaattagttgtcgctttttagcaaaaatagtgctattataatattatttagtatatatgtactaaataatacattctcataccaaaaagttactacttccattgacgggtcaaccgctttaggaagattggatgttagcgcacaatagcgagtttgatattactgttttgagcatgaatcaagttttcctatg

SEQ ID NO: 821 - DNA, 500 bp, Artificial Sequence
  Synthetic Oligonucleotide
gtttcaacaaccatttaagctaagcaggtgttgcaaaaataagtatatagagactatttacttgcactaactaggctttagaattgttgaagggtataactgagttattaggagggttgaaaggagcgctgcgatcgaacaaaaatcaaagtcagtggttaagcataatcaacaattcaatgacattaatgtgttaacagttgactaagttaaatcgatgacattaatttgttaaaagcgacgctaatttgttaataacgacaataatctgttaacaacgacaaataattagttaatcgacaggacatatggagaatagggaactcgaatccctgacctctgcggtgcgatcgcagcgctctaccagctgagctaattccccttaaaagtgctgagtcttgctaactcaacgcactactacaatataatattttaacattctcctgctgtaggctgagactctttttgtaaaaagacttcttgtactcgttcaagttcta

SEQ ID NO: 822 - DNA, 37 bp, Artificial Sequence
  Synthetic Oligonucleotide
gtttcaatgaccatcccacgttgggatggattgaaag

SEQ ID NO: 823 - DNA, 500 bp, Artificial Sequence
  Synthetic Oligonucleotide
ttggcgtggtcgatcagttctgaactgtctgcccccacactgcccccaaaatcttgattttaatgacattttttttccaattttagggtgtgggtgtcgattgactcattaactgacatcttgacaaattatttgtcattgctatagacaagcctgcaacccttactatacataaggttgtgggctttttgcattggaaatttactcaaaagcaaaattgacaaattaggtgtcgtatattaggagtttgccaaaatatgtgtcgcttttcatttagtccagattttctggctttttgacacattctgtgtcgctcagggtaaaataacaacatgtttgtattaaacacatttgttgtaaatgaatacaggtaatcaagaagctcatgcagttatcactgacttctctgaggaggagaggttaaaactagaagttatccagagtttgatggaaccctgtgatcacgctacctatggacaaaagttaaaagatgcggctca

SEQ ID NO: 824 - DNA, 500 bp, Artificial Sequence
  Synthetic Oligonucleotide
gttgctgaaaccatcccaaggtgggattaggttgaaagagtaatacaagaattgggtggattgaaagcaagtcccaccgtcccctactttagtgcaatgcaagattacacaacaaacttgctctgaatgtatggaaggttcgtaaaagtggtgacaaataatttgtcaagatgacatcaatttgacaacgatgacaaataattagtcaatcgacatgtgggcaacaccgtcagaacaactcagaaaactctgaaacgatgggggtggtgggacttgaacccacacgtctttttacggacaacggattttaagtccgcagcgtctaccattccgccacacccccaagagcagtgacagggttctagtttagcagcaaatggcggccactgcatggaacagaaccctcagaaaatctaatcaatctgcctcttgcgctccgatgggttgaattgtttatgatgggagggcgtttgctactgcgttggtgactgccaatatcg

SEQ ID NO: 825 - DNA, 37 bp, Artificial Sequence
  Synthetic Oligonucleotide
gtttccaaagccctctcgttaggtggtgggttgaaag

SEQ ID NO: 826 - DNA, 500 bp, Artificial Sequence
  Synthetic Oligonucleotide
taccttctggacattgcccacatctgtctcgtcctgaccttcttgcctcaatattaactagtaattaattttttgatccatattttaggaaattaaccgaagcgtattgagtgtgaacaagggaatatctttgaaattttaattcggcatagacgaacgatattatctaattaataacgacatgaatttgcaaattgcgacattgaatttgcgaatgtacacatggtgtccattaaataattattgtcacttttaaagaattattgtccagttttacgatatctgtataacaggctcaaaggcttaccaaacaagtctttgagctatatttatacttttattattctctagccagttttaaagtaaatgatgtcatttttctgataaatttttaaagtaaatgatgtcatttttcttggaagacgggtcaagtgtatgtctacgcgttctttgagtcaaggcgctaatctccccggtcatgaggaagttcttgcaacgga

SEQ ID NO: 827 - DNA, 1000 bp, Artificial Sequence
  Synthetic Oligonucleotide
gcatatagggtgataaatccaaaccaataacttccgcttgccagaaagcctgttttaacattaaagttgtggaacctgtgccgcaacctaaatcaagtatgcgtcgtggtttcaccttgacggcatcaactaaagcttgacggacaatactttcattcggtggcagaacatattgggtaatcggatcgtaagtaactgctgcactggaattgagatatccgcctgtaacaccatgaaaattttgactactgtagtacgccggaattatcacatcatctcgttggaagcgatcgctctctttctcccagtcaatactatcagcgtaacgccgtaacccgtcttcatcaatcaaaagacgcactacaggggataaaaaacgttcccagattgtatcttgacgcactaccatattgtgtcagaactttaaaagtttacttaagtaaagtaattttctttacaaattttaatacatttatgagacatctgctttctgtctgtggtattggcttgacgcttgtaattattttagttacacttgtaatacaaagaagctactctctaaaagtagttcttcagcttcacgaaaattgagcgaacaaaatgaaagacaatataacatttaaattgctacaactaactagtagtatgtcaatttgaaatcaatgccttacaacaaacctacagaacttatttcaaaaaccaaatactagtcatatcgataataagttataagtcatatcgatacttatcagtgacatcctcacctacctaaaggcgcggtgattctggagtaatgagtaataagtaatgagtaaatacccatttttcatccactcattactcattactccttactcattactcattactttaaagcattgtgtgaagcacagggcttcagatccaaatatgtggtgacatcgacccaatcgaaaatctaaaattcaaaatccaaaatagaaacaattatgccatacgaaaagttagaaattaccacacc

SEQ ID NO: 828 - DNA, 1662 bp, Artificial Sequence
  Synthetic Oligonucleotide
atgacggcagataaccatgatgcctctgcaattgtgaccgaactttcgcatgaggcaaaactgaagctagacattattgagagtttgctggaaccgtgcgatcgccaaacttacgggcaacgacttaaagaagctgccaataaacttggcaaatcagtaagaacggtgcagcgattggtagaaaagtgggaagcagaaggtttactagccttaactggcacagagagggcagataaaggcaagcatcgcatttctcaaaagtggcaagactttattatcaaaacctaccgtgaggggaataagtgtagtaagcggatgtcccgcaagcaggttgctttaagggttgaagttagagctaaggaattaggagaagaggattatccgaattaccgcacagtttatcgagtattacaacccttgattgaagcgcaagagcaaaagaaaggggttcgtagtccagggtggcgaggttcacacttatcggttaaaacccgcacaggcgagaatatttcagtggagtacagcaaccatgtgtggcagtgtgaccatacttgggtcgatgtgctggtcgttgatatagagggggtaattatcggtcgcccctggttaacgacagtaattgatacatactcacgctgcattatgggtattcgcgtggggtttgatgcaccgagtgctgaggtagtagcgttggcgttgcgtcatgcaatgctacccaaaaactatggggctgagtatgggttgcattgtcagtggggaacgtatggcaaaccagaatatttatttacagatggcggcaaagattttcgctcagaacacttaaagcaaattggcgtacagttaggttttagttgtattctacgcgatcgccctagtgaaggtggtgtggttgagcgcccgtttgggactttgaatacagagttatttgcaggattccctggatatgttggctcaaatgtccaacaacgtccagaacaagcggaaaaggaagcgtgtttaactttacgggaactagaaaagcggattgttcgctacatcgtagataactataatcaacgaattgataagcgcatgggagatcagatgcgctatcagcgttgggaagcaggtttattagccacaccagatttaattggtgagcgagatttagatatttgtttgatgaagcaaaccaatcgctcaatttaccgagagggttatatccgctttgagaatttgatgtatcaaggagagcatttagcgggatatgcaggggaacgggtggttttgcgctacgaccctagagacattaccagcgtgctggtttatcaacggcaaaaagataaagaaatatttttagcaggggcgaatgcgactgggttagagacagaacaagtatcgctagaagaagttaaggcaagtaataagaaggttagggaaaaaggaaaaacgattagtaatcattcgattttggaagaagtaagagacagagatatttttgttgccaagaagaagaccaagaaagaaaggcaaaaggaagaacaaaaacaattacactctgctgtcccgaaatccaagccttttgaggttgaaccagaaccagagattgaagatacgccagtacctaaaaagaaaccaagggtattgaattatgaccagttaaaagaggattatgggtggtaa

SEQ ID NO: 829 - protein, 553 aa, Artificial Sequence
  Synthetic Peptide
MTADNHDASAIVTELSHEAKLKLDIIESLLEPCDRQTYGQRLKEAANKLGKSVRTVQRLVEKWEAEGLLALTGTERADKGKHRISQKWQDFIIKTYREGNKCSKRMSRKQVALRVEVRAKELGEEDYPNYRTVYRVLQPLIEAQEQKKGVRSPGWRGSHLSVKTRTGENISVEYSNHVWQCDHTWVDVLVVDIEGVIIGRPWLTTVIDTYSRCIMGIRVGFDAPSAEVVALALRHAMLPKNYGAEYGLHCQWGTYGKPEYLFTDGGKDFRSEHLKQIGVQLGFSCILRDRPSEGGVVERPFGTLNTELFAGFPGYVGSNVQQRPEQAEKEACLTLRELEKRIVRYIVDNYNQRIDKRMGDQMRYQRWEAGLLATPDLIGERDLDICLMKQTNRSIYREGYIRFENLMYQGEHLAGYAGERVVLRYDPRDITSVLVYQRQKDKEIFLAGANATGLETEQVSLEEVKASNKKVREKGKTISNHSILEEVRDRDIFVAKKKTKKERQKEEQKQLHSAVPKSKPFEVEPEPEIEDTPVPKKKPRVLNYDQLKEDYGW

SEQ ID NO: 830 - DNA, 837 bp, Artificial Sequence
  Synthetic Oligonucleotide
atggcagaaaataaatctcaatctgttgccgaacaattaggagaaatcaagtctttagatggcaaattacaagcggaaattgaccgattaagagaaaaaattattgtagagttggagcaggttagcgacctccataattggttagaaggaaagcggcgatcgcgtcattcttgtaaaattgtcggggattcgcggacaggaaaaactgtagcttgtgattcttatagattaaggcacagaccaattcaagaagtaggaaaaccgccaactgtacctgtcgtgtatattcaacctccccaagaatgcagttcaagagagttatttcgggtgattattgagcatctgaaatacaaaatggtaaagggaacggtgggggaaatccgcagtaggacgctacaggttcttaaacgctgcaatgtagaaatgttgattattgatgaagcggatcggttaaagcccaaaacttttgcggatgtacgggatatttttgacaatttgggtatttctgtagtcttagtaggaacagatcgtctcaataccgtgattaaaagagatgaacaggtttataaccgtttccgtccttcttatccttttggtaggttgcaggggaataagtttaaggagacagtggagatttgggaacaggatattttgcgtttacctgtaccctcgaatcttggtagtaagccaatgttaaagatcctgggagaagcaacaggcggttacattgggttgatggatatgattttgcgtgaagcgggaattagggctttggaaaagggattaacgaagatcgatcgggaaactttggaagaggtagcacaggagtataagtga

SEQ ID NO: 831 - protein, 278 aa, Artificial Sequence
  Synthetic Peptide
MAENKSQSVAEQLGEIKSLDGKLQAEIDRLREKIIVELEQVSDLHNWLEGKRRSRHSCKIVGDSRTGKTVACDSYRLRHRPIQEVGKPPTVPVVYIQPPQECSSRELFRVIIEHLKYKMVKGTVGEIRSRTLQVLKRCNVEMLIIDEADRLKPKTFADVRDIFDNLGISVVLVGTDRLNTVIKRDEQVYNRFRPSYPFGRLQGNKFKETVEIWEQDILRLPVPSNLGSKPMLKILGEATGGYIGLMDMILREAGIRALEKGLTKIDRETLEEVAQEYK

SEQ ID NO: 832 - DNA, 510 bp, Artificial Sequence
  Synthetic Oligonucleotide
atggatcagattcaaccctggttgtttacgatcgcaccactagaaggagaaagtttaagtcattttctaggacgttttcggcgggaaaatgatttatcggcttcagggttaggaaaagaggcgggaattggtgctgttgtagcacgatgggaaaagttctatctcaatccgtttccctcgcttagagagttggaagcattggctaaggtggttcaggtggatagcgatcgcttgcgggagatgttaccacctgaaggggtggggatgaagcacgaaccaattcgcctctgtggggcgtgttatgccgagtcgccttgtcacaagattaaatggcagtttaagaagacgcagggatgcgatcgccaccagctaagtttactttcagaatgccctaactgtggagcaaggtttaaaattccggctttatgggcagatggatggtgtcagcgttgttttacaacttttgcagaaatgggaaaaatgcaaaagggtcaaagaaacagtctgtga

SEQ ID NO: 833 - protein, 169 aa, Artificial Sequence
  Synthetic Peptide
MDQIQPWLFTIAPLEGESLSHFLGRFRRENDLSASGLGKEAGIGAVVARWEKFYLNPFPSLRELEALAKVVQVDSDRLREMLPPEGVGMKHEPIRLCGACYAESPCHKIKWQFKKTQGCDRHQLSLLSECPNCGARFKIPALWADGWCQRCFTTFAEMGKMQKGQRNSL

SEQ ID NO: 834 - DNA, 1863 bp, Artificial Sequence
  Synthetic Oligonucleotide
atgagccagataactgttcagtgtcgtttggttgcaagtgaatcaactcgccatcatctctggaaactgatggcagacctgaatacgcccttaattaacgaattactggcgcaaatggctcaacatcaagactttgaaacctggaggaaaaagggcaagcttccggctggaatagtcaaacagctatgccaacctcttaaaactgaccctcgcttcactaatcaacctgcacgattttatacaagtgcaattaccctcgttgactacatctataaatcttggtttaaaattcagcaacgcctagaacaaaacctaaaagggcaaattcgttggctagaaatgctcaaaagtgatgaagaattagctgccgaaagtaacacatctatagaagtaattcgcactaacgccgccctacttattacttccctatcctctgaagaggattctgaagatgagagtgtttctaccagactttggaaagcatacaacggcacagacgacatccttactcgctgtgttatctgctacttactcaaaaatggtagtaaagtcccaaaaaaacctgaagaaaacttagaaaagtttgctaaacgccgtcgcaaagttgaaattaagattgaacgcttaaaacgacaactagaaagtcgcattccaaaaggtcgaaatttaacaggagaaaactggttagaaacattagcgatcgcatctaccactgcccccgcagatgaatcagaagctaaatcctggcaagatacactgctaactgaatcaaaacttgttcctttccccgtagcctacgagactaacgaagatttaacttggagtaaaagcgaaaaaggtcgtctttgcgttcaatttaatggcttaagcaagcatatattccaaatctattgcgaccaacgccaacttaaatggtttcaacgctttcaggaagatcaagaaatcaaaaaagctagtaaaaatgaatattctagtggtcttttcaccctgcgctcaggaagaattgcttggcaagaaggcacagataagggtgaaccttggaatattcatcacctcatcctctactgcaccgtagacacccgtttatggacggcggaaggtacagaacaagtttgccaggaaaaagcagaagatatcgctaaaatccttaccaacatgaataaaaaaggcgatctccatgacaaacagcaagcctttatttgccgtaaacagtcaaccctagcccgacttaaaaacccttttccccgtcctagccaacccctctatcaaggtcagccttatattcttgtaggtgtagcattaggactggataaacctgctaccgcagcagttattgatgggataacaggtaaagcgatcgcttaccgtagtgtcaaacaactacttggagataaatacgaactgctaaataagcagcgccagcgtaaacaacggcaatctcatcaacgccacaaagctcaaagcaatggcagaactaatcaatttggagatgctaaattaggtgaatatgtagatcgcttattagcgaaagctattgtcacccttgctcaagcccatcacgcagctagtattgttttaccgaaactaggcgatatgcgtgagctagtccagagtgaaattcaatccagagcagagcaaaaaattccaggttatatcgaaggacaggaaaaatatgccaagccgtacagggttagcgttcatcaatggagctatggcagactcattgacaatattaaagctcaagctgccaaattaagtattgtcgttgaagaagcaaaacaacccattcgtggtagtcctcaagagaaagccaaagaaattgcaatttctgcctatggcgatcgctctaaatctggaagctaa

SEQ ID NO: 835 - protein, 620 aa, Artificial Sequence
  Synthetic Peptide
MSQITVQCRLVASESTRHHLWKLMADLNTPLINELLAQMAQHQDFETWRKKGKLPAGIVKQLCQPLKTDPRFTNQPARFYTSAITLVDYIYKSWFKIQQRLEQNLKGQIRWLEMLKSDEELAAESNTSIEVIRTNAALLITSLSSEEDSEDESVSTRLWKAYNGTDDILTRCVICYLLKNGSKVPKKPEENLEKFAKRRRKVEIKIERLKRQLESRIPKGRNLTGENWLETLAIASTTAPADESEAKSWQDTLLTESKLVPFPVAYETNEDLTWSKSEKGRLCVQFNGLSKHIFQIYCDQRQLKWFQRFQEDQEIKKASKNEYSSGLFTLRSGRIAWQEGTDKGEPWNIHHLILYCTVDTRLWTAEGTEQVCQEKAEDIAKILTNMNKKGDLHDKQQAFICRKQSTLARLKNPFPRPSQPLYQGQPYILVGVALGLDKPATAAVIDGITGKAIAYRSVKQLLGDKYELLNKQRQRKQRQSHQRHKAQSNGRTNQFGDAKLGEYVDRLLAKAIVTLAQAHHAASIVLPKLGDMRELVQSEIQSRAEQKIPGYIEGQEKYAKPYRVSVHQWSYGRLIDNIKAQAAKLSIVVEEAKQPIRGSPQEKAKEIAISAYGDRSKSGS

SEQ ID NO: 836 - DNA, 1695 bp, Artificial Sequence
  Synthetic Oligonucleotide
atgtctaatgctcatccctcagaaacgattccagatgagaggggcaacctcgaagaagccaataccatcgcctctgagttttccgacgaggcgaagctcaagatcgaagtgattcaaagccttatggaggcaggcgatcgcgccacgtatgcccaaaagcttaaagaagctgctcaaaaactgggcaagtcggtgcggacggtgcggcggttagtggataaatgggaagaacaagggctgtcgggtctggttgaaactgaacgctctgataaaggtaagcaccgagttgatactgactggcaagatttaattctcacaacctatcgggaaggaaataagggcagtaaacggatgaccccgaagcaggttttcctaagagtacaagcaaaagctcacgaattaggggtcaagtctcccagccacatgacggtgtaccgcatcctcaaccctttaattgaaaaacaagaaaaagccaaaagcattcgcagtccgggatggcgaggatcgcgtttgtcggttaaaactcgcgacggtgcagatttggcagtggagtacagcaaccaggtgtggcaatgcgatcacactcgcgctgatctgttgctagtggatcagcatggggaaattttaggtcgtccttggttgaccacggttattgatacctattctcgctgcattctgggcattaatttaggctttgacgctcccagttctcaggtagtggctttagctttgcgccatgctattttgccgaagcaatacggtgcagaatatggtctgcattgccagtggggaacttatgggaagccagagcatttttatactgatggcggtaaggattttcgttcggaacatttgcagcaaataggagtgcagttagggtttgtttgccatttgcgcgatcgcccctctgaaggtggtattgtcgagcgtccctttggcacattgaacaccgagctattttccactttgccgggatatacggggtcaaatgtacaaaagcggccggaagatgcagaaaaagaagcctgtttgactctgcggcagttagagcagcatttagtccgctatcttgttgataactacaatcagcgtcttgacgctcggatgggcgaccaaacaaggtttcaacgatgggaagctggtttacttgctatgccacctttaatctcagaaagagatttggatatttgcttgatgaaacagtcgaggcgaattattcaaagggggggctacttacaatttgaaaactttatgtatcggggtgaatatttggcgggttacgcaggggaaagtgtagtgctgcgatatgaccccaaagatattacaaggcttttggtttaccgcaatgagggtagtaaggaggtatttttagcccgtgcagtagcacaagatttagaagctgaagaactatctttagatgaggcgaaagctagcagccgcaaggttcgggaagctgggaaggcggttagtaaccgttcgattttggatgaggtgcgcgatcgcgacactttcgtcactcagaagaaaacgaaaaaggaacgccaaaaggctgaacaaggtgaaatccgtaaggcaaaacagcctgtatctatggaaccggaaccggaggaagtggtatcgaacaacagtgaagctgaaccagaaatgccggaagtattggattacgaacaaatgcgcgaagattacgggtggtaa

SEQ ID NO: 837 - protein, 564 aa, Artificial Sequence
  Synthetic Peptide
MSNAHPSETIPDERGNLEEANTIASEFSDEAKLKIEVIQSLMEAGDRATYAQKLKEAAQKLGKSVRTVRRLVDKWEEQGLSGLVETERSDKGKHRVDTDWQDLILTTYREGNKGSKRMTPKQVFLRVQAKAHELGVKSPSHMTVYRILNPLIEKQEKAKSIRSPGWRGSRLSVKTRDGADLAVEYSNQVWQCDHTRADLLLVDQHGEILGRPWLTTVIDTYSRCILGINLGFDAPSSQVVALALRHAILPKQYGAEYGLHCQWGTYGKPEHFYTDGGKDFRSEHLQQIGVQLGFVCHLRDRPSEGGIVERPFGTLNTELFSTLPGYTGSNVQKRPEDAEKEACLTLRQLEQHLVRYLVDNYNQRLDARMGDQTRFQRWEAGLLAMPPLISERDLDICLMKQSRRIIQRGGYLQFENFMYRGEYLAGYAGESVVLRYDPKDITRLLVYRNEGSKEVFLARAVAQDLEAEELSLDEAKASSRKVREAGKAVSNRSILDEVRDRDTFVTQKKTKKERQKAEQGEIRKAKQPVSMEPEPEEVVSNNSEAEPEMPEVLDYEQMREDYGW

SEQ ID NO: 838 - DNA, 837 bp, Artificial Sequence
  Synthetic Oligonucleotide
atgacgaatcaagaagcccaagcagtcgccaaggaattaggcgatattccgcttaatcaagaaaaaattcaagcggaaattcaaagattgaaccgcaagacttttgtgcagttggaacaggtgaaaattctccatgactggctggaaggaaagcgacagtctcggcagtcggggcgagttgtgggcgagtcgaggacgggcaaaactatggggtgtgatgcttacaggttacggcacaaacccaagcagcagccgggacagccgccaacggttcctgtggcttacatccaaattccgcaagagtgtggcgcgaaggaattgtttggggtgcttcttgagcatttgaagtatcaggtggttaagggaacgatcgccgaaattcgcgatcgcacgatgcgggtgctcaagggttgctgcgtggagatgctgattattgatgaagcggatcggtttaaacctaagacgtttgctgaggtgcgcgatatttttgataggttggaaattccggtgattttggtaggaaccgatcgcttagatgcggtgattaagcgggatgaacaggtttataaccgttttcggtcaagtcatcggtttggtaagttgtcgggcgaggagtttaagcggacggtggaggtttgggaaaagagggttttgctgttacctgtggcttctaatctttctagtaaggcgatgttgaagaccttgggggaggcgactgggggttatgtggggctattggatatgattctccgagaggcggcgattcgggctctgaagaaggggttatcaaggattgatttggaaactcttaaagaagttgctgcggagtacaagtga

SEQ ID NO: 839 - protein, 278 aa, Artificial Sequence
  Synthetic Peptide
MTNQEAQAVAKELGDIPLNQEKIQAEIQRLNRKTFVQLEQVKILHDWLEGKRQSRQSGRVVGESRTGKTMGCDAYRLRHKPKQQPGQPPTVPVAYIQIPQECGAKELFGVLLEHLKYQVVKGTIAEIRDRTMRVLKGCCVEMLIIDEADRFKPKTFAEVRDIFDRLEIPVILVGTDRLDAVIKRDEQVYNRFRSSHRFGKLSGEEFKRTVEVWEKRVLLLPVASNLSSKAMLKTLGEATGGYVGLLDMILREAAIRALKKGLSRIDLETLKEVAAEYK

SEQ ID NO: 840 - DNA, 510 bp, Artificial Sequence
  Synthetic Oligonucleotide
atggaagcgatcgatatccagccttggctgtttcgggtggaaccgttggagggagagagtttgagccattttttggggcggtttcgacgggcgaataagttaacgccgaatgggttgggtaagatggcggggttgggaggcgcgatcgcccgttgggaaaagtttcgctttaatccgcctccttctcctcagcagttggatgcgttggcggcggtggtgggagttgaaaaggaacagttacaggaaatgttaccgcctcctggggtggggatgaagttagagccgattcggttgtgtggggcgtgttatgcccagtcgccttgtcatcagattgaatggcagtttaagacgacacaaggatgcgatcggcacaaattacgcttgctgtcggagtgtcccaactgcggggcgaggtttaagattccggcgttgtgggtggatgggtggtgttctcggtgttttttgtcctttaaagatatagtaaagtggcagaaaactactttgccataa

SEQ ID NO: 841 - protein, 169 aa, Artificial Sequence
  Synthetic Peptide
MEAIDIQPWLFRVEPLEGESLSHFLGRFRRANKLTPNGLGKMAGLGGAIARWEKFRFNPPPSPQQLDALAAVVGVEKEQLQEMLPPPGVGMKLEPIRLCGACYAQSPCHQIEWQFKTTQGCDRHKLRLLSECPNCGARFKIPALWVDGWCSRCFLSFKDIVKWQKTTLP

SEQ ID NO: 842 - DNA, 1914 bp, Artificial Sequence
  Synthetic Oligonucleotide
atgagccacatcaccatccagtgccgtttagtcgctagccttccgacccgccgccaactctgggaattgatggcagacaaaaacacgcccctaatcaacgaactactggcactcgtagccaatcaccccgacttcgagacatggcgacaaaaaggcaaacttcccagcggtacagtcaaacaactgtgtcagcctctcaaaaccgacccccgtttcatcagtcaacccgcacggttttacaccagtgccattaaggttgtggactacatatacaaatcttggcttgccttaatgaagcggttgcaataccaattagaagggaaaacccgctggctagaaatgctcaaaagcgatgccgaactcgtagaaagtagcggtgtcaccttagaaactctccgcagcaaagctactgaaattttggctcaattaacacccgagtccgactccgttgcatctcaaccaccaaaagctaaaagtaaaaaaaagaaaaaatccaaagccttagatagcaagccgaatgtatctcacattttatttgatgcttatcgcaatacagcagatattttgaatctatgcgccatcagctacctactcaaaaatggctgcaaaatcaacgataaagaagaagaccaaaataaatttagccaacgccgccgcaaagtcgaaattcagattcaacgcctcacagaaaagctaactgctcgaattcccaaaggtcgagatttgaccaatactagatggttggagacattagccgaagctacatcctgcgttccccaaaacgaagctcaagctaaatattggcaagataatctactcaaaggatttagcctcgtgccatttcccatcatttatgaaactaacgaagacatgacctggtttaaaaacgtttcaagccgtctctgtgttaaattcagcggcttaggcgaacatacctttcaagtgtattgcgaccaacgccacttgcactggttccaacgatttttagaagaccaagaaattaagaaaaacagcaaagatcaacattccagtggcttatttaccctccgtagtagtagtatggcatggcaagaaggagaaggaaaaggagagccgtggaaccttcaccatttaaccctctactgttgcgtggatacccgcctgtggactgccgaaggaacaaaacaggtaaaagaagaaaaagctaccgaaatcgctaaaatcctcaccaaagccaaagagaaaggcgacctaaatcaacagcaacaatcctttatccaacgcaaaaattccaccttaactagaatcaacaatcctttcccgcgtcccagccaacctttatatcagggtcaaggtaacattttagttggcgttagtctaggtttggagaaacctgcaactgtagccgtagtagatgcgatcgcacacaaagttattacctaccgtagcatccgccagctactcggcgagaattacaaattgcttaaccgacaacggcaagcacaacgttcctcatcccatgaacgtcaaaacgcccaaagacgagacgctttcaatcaattgggagagtctgagttaggtgaatatatcgacagattactggctaaagagattgtagcgatcgcgcaaaaataccaagctggtagcattgttttacccaaactcggcgatatgcgggaaatagttcaaagcgaaattcaagccttagccgaacaaaaatgcccagaatttttagaaggacagcaaaaatatgccaaacaatatcgcgtcagcgttcatcagtggagttacgccagattaattgactgcattcagactcaggcgaaaaagcttggcattgcgatcgaagaggggcagcagccagttcgaggtagtccccaggacagggcgaaagagttggcgatcgcggcctatcacttacgttctaaagcttaa

SEQ ID NO: 843 - protein, 637 aa, Artificial Sequence
  Synthetic Peptide
MSHITIQCRLVASLPTRRQLWELMADKNTPLINELLALVANHPDFETWRQKGKLPSGTVKQLCQPLKTDPRFISQPARFYTSAIKVVDYIYKSWLALMKRLQYQLEGKTRWLEMLKSDAELVESSGVTLETLRSKATEILAQLTPESDSVASQPPKAKSKKKKKSKALDSKPNVSHILFDAYRNTADILNLCAISYLLKNGCKINDKEEDQNKFSQRRRKVEIQIQRLTEKLTARIPKGRDLTNTRWLETLAEATSCVPQNEAQAKYWQDNLLKGFSLVPFPIIYETNEDMTWFKNVSSRLCVKFSGLGEHTFQVYCDQRHLHWFQRFLEDQEIKKNSKDQHSSGLFTLRSSSMAWQEGEGKGEPWNLHHLTLYCCVDTRLWTAEGTKQVKEEKATEIAKILTKAKEKGDLNQQQQSFIQRKNSTLTRINNPFPRPSQPLYQGQGNILVGVSLGLEKPATVAVVDAIAHKVITYRSIRQLLGENYKLLNRQRQAQRSSSHERQNAQRRDAFNQLGESELGEYIDRLLAKEIVAIAQKYQAGSIVLPKLGDMREIVQSEIQALAEQKCPEFLEGQQKYAKQYRVSVHQWSYARLIDCIQTQAKKLGIAIEEGQQPVRGSPQDRAKELAIAAYHLRSKA

SEQ ID NO: 844 - DNA, 1695 bp, Artificial Sequence
  Synthetic Oligonucleotide
atgttgaatcagcagccaacagatccggtagcaccggagagtaatgaaataattgccacgctttcagccaatgcgaaatttcggctagaagtgctacagacgctggttgttccgggcaatcggacaacctatggagaacgattgcgagaagcagcccaaaaacttgggaaatcgatccggactgtgcagcggatggtcaaggactgggaacgaaatggcttgtcagccttggaaggtggtgcaagagcggataaagggcaaccacgcattgggcaagagtggcaagatttcattatcaagacctaccagagtggcactaaagacagcaagcgtattactccggcacaggtggcggttcgggttaaggtacgggcacagcaattgggcgtagagaaatatcccagccacatgacggtttatcggattctggagccgctgatcgcgaaaaaggagcagcagaataataagcgaagtattggctggcgaggctcgcggctttcgctctcaaccagggcaggacaggatttagcaattgagtatagcaatcatgtttggcaatgtgaccacactcgtgcggacgttttgctggttgaccagcatggggaaatgttgggacggccttggctgacgacggtaatcgatacctattcccggtgcattgttgggattaatttggggtttgatgcacccagttctcagcttgtggcgttggccttgcgtcatgcaatgttgccgaaacgctatgggagcgaatatgggctgaattgtgagtggggaacctccgggaagccggagcatttctttacggatggtggcaaggattttcgatcggatcatattcagcaagtctcaatgcagattgggtttgtttgccacttgcgcgatcggccttcggaaggaggcgtagttgagcggccatttggcacgttgaatactgagtttttctcacacttgcctggatatacggggtcaaatgtccaagatcggccagaggaagcggagaaatcagcttgtttgaccctgagagaactggagcagcaactggttcggtacttggtggataactataaccagcggctggatgcccggatgaaggatcaaacgcgctttcaacggtgggaggcggggttaattgctaatcccgatatttttacggagcgggaattggatatttgcctgatgaagcaaacccgacggacggtttaccgagagggctatctacgctttgagaatttgacctatcggggagagaatctggctggctatgctggtgaaacagtggtgctgcggtttgacccacgggatattacgacgatttatgtttaccggactgagggggagaaggaggtctttcttaccaatgctcatgctcaggatttggaaactgagacgatcgcgcttgatgaagcgaaagccagtagccgcagggtgcgggaggcgggaaaaaccattagcaatcgatcgattctagaggaggtgcgcgatcgggatgtatttgtcgagaagaagcagaagggtcggaaggcaaggcaaaaagcagaacaggaacgcttgcccagtcggcctcaaccgcagtcggtagaaattgcggcggttgaaccggacgaaatcgtcgaaaagactggggtggatgaatcctgggtaatgccagaggttatggattatgaccaactacatgatgattttgggtggtaa

SEQ ID NO: 845 - protein, 564 aa, Artificial Sequence
  Synthetic Peptide
MLNQQPTDPVAPESNEIIATLSANAKFRLEVLQTLVVPGNRTTYGERLREAAQKLGKSIRTVQRMVKDWERNGLSALEGGARADKGQPRIGQEWQDFIIKTYQSGTKDSKRITPAQVAVRVKVRAQQLGVEKYPSHMTVYRILEPLIAKKEQQNNKRSIGWRGSRLSLSTRAGQDLAIEYSNHVWQCDHTRADVLLVDQHGEMLGRPWLTTVIDTYSRCIVGINLGFDAPSSQLVALALRHAMLPKRYGSEYGLNCEWGTSGKPEHFFTDGGKDFRSDHIQQVSMQIGFVCHLRDRPSEGGVVERPFGTLNTEFFSHLPGYTGSNVQDRPEEAEKSACLTLRELEQQLVRYLVDNYNQRLDARMKDQTRFQRWEAGLIANPDIFTERELDICLMKQTRRTVYREGYLRFENLTYRGENLAGYAGETVVLRFDPRDITTIYVYRTEGEKEVFLTNAHAQDLETETIALDEAKASSRRVREAGKTISNRSILEEVRDRDVFVEKKQKGRKARQKAEQERLPSRPQPQSVEIAAVEPDEIVEKTGVDESWVMPEVMDYDQLHDDFGW

SEQ ID NO: 846 - DNA, 840 bp, Artificial Sequence
  Synthetic Oligonucleotide
atgacgacagttcaagcagcacagaccgttgcggatcacttggggccagtggcattggccagtgagaaggttcaagccgagatagctcggttaaaccgcaagagttttgtcgaattggctcaagtgcaaagcctgcatggttggctggaaagtaaacggcagtcgaagcaatgctgtcgtgtcgtgggggaatcacggacggggaaaaccttggcttgtgatgcttatcggctacgccataggccgagccaacaaccaggaaagccgccgatcgtacccgtgatttacattcaagtgccgcaggaatgtggatcgaaggaactgttccaaatcatcatcgagcatcttaagtatcagatggtgaaggggacggtggcagaaattcgggaacggacaatgcgagcgctgaagggttgtggggtagagatgctgatcattgatgaggccgatcggttgaagcccaagacttttgcggatgtgcgggatatttttgacaaactggagattgcggtggtgctggtgggtaccgatcggctggatgtggtggtgaagcgggatgagcaggtttacaaccgttttcgggcctgtcatcggtttgggaagttggcgggggaggagtttcaacggacgatcgaggtgtgggaaaagcaggtgctgaagttacctgtggcctcgaatttgacgagtaagtcgatgatgaaggtgattggagaggcgacggcagggtatatcgggttgatggatatgattttgcgggaggcggcgattcgatcgttgaagaagggattgccgaagattgatttggagacgctgaaggaagtggcggcggagtatcgatga

SEQ ID NO: 847 - protein, 279 aa, Artificial Sequence
  Synthetic Peptide
MTTVQAAQTVADHLGPVALASEKVQAEIARLNRKSFVELAQVQSLHGWLESKRQSKQCCRVVGESRTGKTLACDAYRLRHRPSQQPGKPPIVPVIYIQVPQECGSKELFQIIIEHLKYQMVKGTVAEIRERTMRALKGCGVEMLIIDEADRLKPKTFADVRDIFDKLEIAVVLVGTDRLDVVVKRDEQVYNRFRACHRFGKLAGEEFQRTIEVWEKQVLKLPVASNLTSKSMMKVIGEATAGYIGLMDMILREAAIRSLKKGLPKIDLETLKEVAAEYR

SEQ ID NO: 848 - DNA, 510 bp, Artificial Sequence
  Synthetic Oligonucleotide
atgatggacgatctagagattcagccttggtttttccaagtggaaccttatgagggggagagtattagccattttttggggcggtttcggcgggcaaatgagctaactccgggtgggttggggcagatggcggggttgggggcggcgatcgggcggtgggagaagtttcggtttaatcctcgtccgacgggggagcagttggagaaactggcggtggtggttggggtgccgacggagcggctatggcagatgttgccgggggatggggtggggatgaagatggagccgattcggttgtgtggggcttgctatggggaggtagcttgtcatcggattgagtggcagcttaaggagacaagtgggtgcgatcgccaccaattgcggttgctatcggaatgccctacttgtggagcaaggttttcagttccagcttcgtgggttgagggtaattgtaagcggtgctttactcctttttcagcaatggctatgcatcagaaatcgattgcttga

SEQ ID NO: 849 - protein, 169 aa, Artificial Sequence
  Synthetic Peptide
MMDDLEIQPWFFQVEPYEGESISHFLGRFRRANELTPGGLGQMAGLGAAIGRWEKFRFNPRPTGEQLEKLAVVVGVPTERLWQMLPGDGVGMKMEPIRLCGACYGEVACHRIEWQLKETSGCDRHQLRLLSECPTCGARFSVPASWVEGNCKRCFTPFSAMAMHQKSIA

SEQ ID NO: 850 - DNA, 1905 bp, Artificial Sequence
  Synthetic Oligonucleotide
atgagcaacattacaattcaatgcaagctcgttacaactgaggtaactcgtcattacatctggcatttaatggcagaaaaacacactcctttaatcaatgaattactaaagtgtattgcccaagattcccattttgaggagtggtgccacgcgggcaaaattccccttgaagctgttcgcaagacttgtaagcaattacagcaaaattctcaatttataggacagcctggaagattctattcctcagcaaccgctaccgtatatcgaatctgcaagtcctggttagctcttaggacacgacttagaaaccagattgcgggtcaaactcgatggttggctatcctccaaagtaatgatgagttaacaatcgctagccagagcgacatcgacatgctgagagctaaagcccgtcaacttctcacgcaactaaatcactcagattcccaggacaacgaaccacaacctaaaaaggcacgcagcaaaaaaaaagagtcaaaacaaccaggatcagctatttctagcaccctctttacactctatggtgagacagaggaagtcttgactcgatgtgcgatcgcttacctgcttaaaaacggttgcaaactgcccgatcgagctgaagaccccaaaaagttcgccaaacgtcgtcgtaaaacagaaatccgccttgaacgtctcgtcaagactcttcaacgtacaaggtttccaaaaggacgagacttgtctgagcatacttggttagaaactttaaccaaggcagaaggttgtgtttccaaagatgacaatgaagcagccgattggcaagccagcctgctaacagagccagctactttaccttttccaatcaactacgaaacaaatgaagatctccgctggtttctgaatgaaaaaggaagactatgtgtcagctttaatggcttaggtgagcattcatttgatatttactgtgatcaaagggatctccactggttcaagcgatttctagaagaccaacagactaagaaagctagcggagacctacactcagccagcttattcaccttacgctctgggcgaattgcttggcaggagggtaaaggcgaaggtgaaccctggaatactcatcggttaattttatcttgcactgtagacacggattcttggactcaagaaggtacggaacaaattcggcagaaaaaagctagtgagtgtgcaaaagttatcgctagcactaaagtcaaggaaaacttgagcaagaaccaagaagcatttattaaaagacggacaacaatgctgactttgcttgataagccattttttcgtccaagccgccctctttatcaaggtcagccatcgattttagcaggtgtaagctatgggcttgataaacctgctactctcgcgattgtcgatattcaaactggtaaagctatcacgtacagaagtatccgacaacttctaggtgaaaactataagcttctcaaccgatatcgtttgcgacagcaacacaacgctcatcagcggcaaaagaaccagcaaaaaggtgcattcaatcggtttggagaatccaactcaggagaacatctagaccgtctaatagctcatgaaatcgtggcgatcgctcaaaagtatcaggtgagcagccttatattgcctgaccttagcaatattcgagaaattgtccaaagcgaagttcaagctaaagcagagcaagaaattcccggttctgtagaactccaacggcaatatgcccttcagtatcgagcaagtgtacatcgttggaggcatgctcaacttagccagtatatcgggagcctagctgcccaagccggaatttctattgaagtagtaaaacaaccatttacaggaacccctcaagagaaggctaaaaaattagcgatcgcaggttatcaatctcgaaaataa

SEQ ID NO: 851 - protein, 634 aa, Artificial Sequence
  Synthetic Peptide
MSNITIQCKLVTTEVTRHYIWHLMAEKHTPLINELLKCIAQDSHFEEWCHAGKIPLEAVRKTCKQLQQNSQFIGQPGRFYSSATATVYRICKSWLALRTRLRNQIAGQTRWLAILQSNDELTIASQSDIDMLRAKARQLLTQLNHSDSQDNEPQPKKARSKKKESKQPGSAISSTLFTLYGETEEVLTRCAIAYLLKNGCKLPDRAEDPKKFAKRRRKTEIRLERLVKTLQRTRFPKGRDLSEHTWLETLTKAEGCVSKDDNEAADWQASLLTEPATLPFPINYETNEDLRWFLNEKGRLCVSFNGLGEHSFDIYCDQRDLHWFKRFLEDQQTKKASGDLHSASLFTLRSGRIAWQEGKGEGEPWNTHRLILSCTVDTDSWTQEGTEQIRQKKASECAKVIASTKVKENLSKNQEAFIKRRTTMLTLLDKPFFRPSRPLYQGQPSILAGVSYGLDKPATLAIVDIQTGKAITYRSIRQLLGENYKLLNRYRLRQQHNAHQRQKNQQKGAFNRFGESNSGEHLDRLIAHEIVAIAQKYQVSSLILPDLSNIREIVQSEVQAKAEQEIPGSVELQRQYALQYRASVHRWRHAQLSQYIGSLAAQAGISIEVVKQPFTGTPQEKAKKLAIAGYQSRK

SEQ ID NO: 852 - DNA, 1866 bp, Artificial Sequence
  Synthetic Oligonucleotide
atggatgaaagccaaattgcattagaagctgatttgcagggattcgatgaggttttgttgagcgatcgagcctttgacaccgatccatcccaaattttaattgaatcgtcagatccacagaagttacgctttcgtctaattgagtggctagcggaggctcccaatcggaaagtgaaggcggaacggaaaaagaagatcgctgaaacgctcgatatatcaactcgtcaggtagagcggttgctcgatcgatacaatgatgagcagttacatgaaactgccggaatcgatcgttcagacaaagggcaacatcggattggcgactattggcccgaatatatccgcagtgtctatgaacaaagtgtcaaagataaacacccgctcactccagcgaatattgtgcgagaggttcaccgtcacgcattaatcgatcttcggcatgaagaaggtgactatcctcatcaagcaactatctaccggattctaaaacctctcatcgaacagcagaagcgaaaaagtaagattcgcaatccaggatcgggatcttggatgagtgttgaaacacgggacggaaagttgctcaaggcggattttagcaatcagatcgttcagtgcgaccatacaaagttagatgttcggatcgtcgatgaggatggcaagcttttaaactggcgaccttggcttaccactgttgtcgatactttctcaagctgtctgattggctatcatttgtggcataaacagccaggatctcatgaagttgcacttaccctcagacatgcagcattacccaagaattatccgccagaatatgagcttcagaagtcgtgggacatctgtggattgccactccagtatttttttactgatggcggcagagatttagctaaatcgaaactcatcaaggcttttggcaataagttcggttttcagtgcgaactgcgagatcgaccgattcaaggtgggattgttgagcgactattcgggacaattaatacacaggttttacaacctctggctggctacatatcaccagaagaagatggcgcaaaacgggcagaaaaggaggcttgtctaactattgaagatgttgacaagattctagccgcttacttctgtgacgactacaatcatcagccatatcctaaagatccccgtgatacccgctatgagaaatggttaagaggaatggggggcaagttgccagaaacactggatgagcgagatctagatattctccttactaaggaaaaacaaaaactcgttcaggagtatggatctatttattttgaaactctaacataccaatgtaaagaattggagccatttaaaggtcaatatgtcaccgtaacctacgatcccgaccatgttctgacgttatatatttacactcaacctattggcgagcgagagagtgaatttatctgctgtgttcatgccaataacatggacattcaagatttgagcctgtatgagctgaaacaatttaacaaggagaaaagtacaacgaaacgagagcactcaaattatagtgcggctatagctttggataaacgacaaaagcttgtagcagaaaggaagcagggcaagaaggagcgtcaacaggcagggcagaaggaactgcgaggaaaaagtaagcagaactcgaatgtggtggaaatgcggaaggttcgagctggtaaatctgctagaaacaacgaaccgatggaactcttgccagaaagggttactcccgaacagatgaagcctcagcctctggtagcgttatctcctgcacccattcttgagcctgatgcttctacacctcgaacgaccgaacggcatcgacttgttattgctaaaaatcaaaaaatgaagagggactggtaa

SEQ ID NO: 853 - protein, 621 aa, Artificial Sequence
  Synthetic Peptide
MDESQIALEADLQGFDEVLLSDRAFDTDPSQILIESSDPQKLRFRLIEWLAEAPNRKVKAERKKKIAETLDISTRQVERLLDRYNDEQLHETAGIDRSDKGQHRIGDYWPEYIRSVYEQSVKDKHPLTPANIVREVHRHALIDLRHEEGDYPHQATIYRILKPLIEQQKRKSKIRNPGSGSWMSVETRDGKLLKADFSNQIVQCDHTKLDVRIVDEDGKLLNWRPWLTTVVDTFSSCLIGYHLWHKQPGSHEVALTLRHAALPKNYPPEYELQKSWDICGLPLQYFFTDGGRDLAKSKLIKAFGNKFGFQCELRDRPIQGGIVERLFGTINTQVLQPLAGYISPEEDGAKRAEKEACLTIEDVDKILAAYFCDDYNHQPYPKDPRDTRYEKWLRGMGGKLPETLDERDLDILLTKEKQKLVQEYGSIYFETLTYQCKELEPFKGQYVTVTYDPDHVLTLYIYTQPIGERESEFICCVHANNMDIQDLSLYELKQFNKEKSTTKREHSNYSAAIALDKRQKLVAERKQGKKERQQAGQKELRGKSKQNSNVVEMRKVRAGKSARNNEPMELLPERVTPEQMKPQPLVALSPAPILEPDASTPRTTERHRLVIAKNQKMKRDW

SEQ ID NO: 854 - DNA, 867 bp, Artificial Sequence
  Synthetic Oligonucleotide
atggcacaatcagaactggcaattcacgttcctgttgaagttttaactacccagttagatatgactgacttgctggctaaagcagcaacgatcgaggagctattcaagacggcatttattccaaccgatcgacattcagagtatgctcgatggatagatgaattacgaattctcaaacattgtggtcgagcgatcgggccaagagatgtggggaaaagtcgttcgtcagtaaattatcgagaggaggatataaagcgggtttcatgtgttaaggcatggtcaaattcaagctctaagcggttgttttcacaaatcctcaaagacattaaccatgcagcttggagaggtaagccaaaagatttacaagctagattagctggctgtttagaactatttgggattgagctgctgttaattgataatgctgataatttacaacgggaggctttgattgacctaaagcagcttcatgaagaatctggagtgccgatcgtcttaattggtgggcaggatcttgacaacaccctggtaaatttcgatttactgacttgttttccgacattatttgagtttgatgctctaggtgaagaggacttaaagaaaacattggagacgatcgaattagatattctggcacttccccaagcatctaatttgtcggaaggaaggctatttgaaattttgcgagatagttctcaaactcgaattggtattttgattaaaatcctatcaaagactgttctacattcgttgaaaaaaggtcatggaaaggttgaggaagagattctgagaaatattgctaatcggtatgggcgacggtacgttccgttggaagctagaaataagccgcagtcgatcgagggttga

SEQ ID NO: 855 - protein, 288 aa, Artificial Sequence
  Synthetic Peptide
MAQSELAIHVPVEVLTTQLDMTDLLAKAATIEELFKTAFIPTDRHSEYARWIDELRILKHCGRAIGPRDVGKSRSSVNYREEDIKRVSCVKAWSNSSSKRLFSQILKDINHAAWRGKPKDLQARLAGCLELFGIELLLIDNADNLQREALIDLKQLHEESGVPIVLIGGQDLDNTLVNFDLLTCFPTLFEFDALGEEDLKKTLETIELDILALPQASNLSEGRLFEILRDSSQTRIGILIKILSKTVLHSLKKGHGKVEEEILRNIANRYGRRYVPLEARNKPQSIEG

SEQ ID NO: 856 - DNA, 546 bp, Artificial Sequence
  Synthetic Oligonucleotide
atgggagagtctgctttgagtcagcttgacgatcgagtgccctggctaggttatgtggaaccatttgagcatgaaagtatcagccattatctcggacggttgcggcgatttaaggcgaatagtctgccgtcggcttatgcgctagggcaggcggcagggattgggggcataacggttagatgggagaagctgtatttcaatccatttccgactgatgaggagttgggatcgatcgccagtttaatcggtttagatttgtcgcggtttcaggatatgttgccgagccgagaaatcacgtttcaacctcgcccgattcggctctgtgtggcttgttatggagaaagtccaggtcatcggatggaatggcagtacaaggatgttgtggcggtttgtcagcgtcacagtctgcgactattggagcgatgcccacaatgcaagaagccgtttgagattccagcgttatggactgccgatcgatgccatcactgtgggatgcggtttacgtcgatggtgaagtatcaggagagaatcaataaagctatctga

SEQ ID NO: 857 - protein, 181 aa, Artificial Sequence
  Synthetic Peptide
MGESALSQLDDRVPWLGYVEPFEHESISHYLGRLRRFKANSLPSAYALGQAAGIGGITVRWEKLYFNPFPTDEELGSIASLIGLDLSRFQDMLPSREITFQPRPIRLCVACYGESPGHRMEWQYKDVVAVCQRHSLRLLERCPQCKKPFEIPALWTADRCHHCGMRFTSMVKYQERINKAI

SEQ ID NO: 858 - DNA, 1935 bp, Artificial Sequence
  Synthetic Oligonucleotide
atgagcatcgttacaattcactgtcgcctagtcgcttctgagcctattcgtcgccacctctggcacctcatggcagagagtaataccccattggtcaacgaactgacaaagttagtcagtcagcaggaagattttaagatctggcaaagcaaaggtaccatttccaaaaagatagttacagctttatgcaaaccgctcagaaaagtttatccaggacaacctgggcgattctactcttctgcgattgcgatggttctgtatacctataagtcatggctggcaattcagaacaatcttcgctatcggattgatggaaagcaacgctggttgaatgtagtcaaaagcgatcgtgaattgcacgaacttagcggttctaatcttgatgtcatcaagcaaaaggcacaagaaattctcgatcgactcaatgccgtaacaaatgaagttgaatcggctcccaatgccaaaaagcgtaaaaaagctaaacagaaagctaaatcatcaaacgatgacaatctgatgtctaagctattcactgcttatgatgataccgaagacaccttgagcaaatgcgcgatttcctacctgctcaagaatgactgcaaagtttcggaaatagaagaagacccagatggatttgcccaccgcatcaatcgtaagaaggaacagatcgagcaacttgaggcagaactgaatgctcgattacctaaaagtcgggatctctcaggggctgagtttctcgaaacactagaactcgcgacctaccaaatttccgaaaatgttgctcaggcaaaagagtgggaggctaaattagaaactaagtctgcatctctgccatatcccattatctatgatagttctggggaagtccgttggggcaaaacgaccaaagggcggataactgtcaacttcaatggtatggataaatatctcaaagcagtcgatcccgacattcaaaaatggtacgaagtccatcaagagaatcctttccagttgtattgcgatcgacgacaattacctttgttccaacgcttttgggaagattggcaagcctatgaaccgaataaagatacatatcccccaggtttactcacgctcagtacagccatgctgatttggacagaaggcgagggtaaaggcgatccttggaatgctaaccatcttgccctccactgctcttacgatactcgcttaatgaccgcagagggaactgcccttgttcaacaggagaaatccgatgaagctcttaaaaacctagagggtgaaaagcccgatcctcgcaaacgatcggagctagctcgactgcaaaatatacccgctcgtcccagccataaaccctaccaaggtaatcccgaaattttggttggactcagtatcggactagccaatcctgtcactgccgcagttgttaatgtcataacgggagaggtactgacctatcgcactcccaagacattactgggcgatcggtaccgtcttctgaatcgtcatcgtactaaacagcagcaaaatatcttacaacgtcaaaaaaatcagaaacgtggaatttccgatcagctatcagaatcagagctgggagaatatgtagaccgtctattggccaatgagattgttaaacttgcacaacaatatcgagcagatagcatcgtaattcccagtctgacacatctgagagaagtacttaatagtgagattactgctagggcaaaacagaaatgtcctggctctgttgaagctcaaaacaaatatgctaaagagttccgtatgagaatttcccgctggagctacaacagacttatagaagctatccgttctaaagctcggagactcggtatcacaattgagtcaggatttcagccagtcagagctagtcctcaagaacgagcgaaagatgtggcgatcgggacttatcactctcgacgaaattctgctgaatga

SEQ ID NO: 859 - protein, 644 aa, Artificial Sequence
  Synthetic Peptide
MSIVTIHCRLVASEPIRRHLWHLMAESNTPLVNELTKLVSQQEDFKIWQSKGTISKKIVTALCKPLRKVYPGQPGRFYSSAIAMVLYTYKSWLAIQNNLRYRIDGKQRWLNVVKSDRELHELSGSNLDVIKQKAQEILDRLNAVTNEVESAPNAKKRKKAKQKAKSSNDDNLMSKLFTAYDDTEDTLSKCAISYLLKNDCKVSEIEEDPDGFAHRINRKKEQIEQLEAELNARLPKSRDLSGAEFLETLELATYQISENVAQAKEWEAKLETKSASLPYPIIYDSSGEVRWGKTTKGRITVNFNGMDKYLKAVDPDIQKWYEVHQENPFQLYCDRRQLPLFQRFWEDWQAYEPNKDTYPPGLLTLSTAMLIWTEGEGKGDPWNANHLALHCSYDTRLMTAEGTALVQQEKSDEALKNLEGEKPDPRKRSELARLQNIPARPSHKPYQGNPEILVGLSIGLANPVTAAVVNVITGEVLTYRTPKTLLGDRYRLLNRHRTKQQQNILQRQKNQKRGISDQLSESELGEYVDRLLANEIVKLAQQYRADSIVIPSLTHLREVLNSEITARAKQKCPGSVEAQNKYAKEFRMRISRWSYNRLIEAIRSKARRLGITIESGFQPVRASPQERAKDVAIGTYHSRRNSAE

SEQ ID NO: 860 - DNA, 1797 bp, Artificial Sequence
  Synthetic Oligonucleotide
atgtacccgcacaatagcgaattactattttgtctaagtcccactatggatgaaatacctatcttcaatcaagacaaagaatctctgccatttgatgacaacaatgatttggcagaaattcagaatgatgagtcagaagaaacaaacgtaattattaccgaactttcggctgaagcaaaactcaagatggaagtgattcaaggtctacttgaaccatgcgatcgcaaaacctatggtcagaaattaagagtagcagcagaaaaactgggcaagactgtcagaactgtccagcgtttagttaaaaagtatcaacaagacggtctatccgcaattgttgacactgagagaaatgataaaggcagttatcggatagaccctgagtggcaaaaatttattatcagcacttttaaagaaggtaataagggtagtaaaaaaatgactccggctcaagtagcaatcagggtacaagtcagagcaggacagctaggtttagaagattaccccagtcacatgacagtttacagagttcttaaccctattattgagcggaaagagcaaaaacagaaagtacggaatgttggatggcgggggtcacgagtatcccacaaaactcgtgatgggcaaacattagatgtacatcatagtaatcatgtttggcagtgtgaccatacaaaactagatgtcatgttggttgatcaatatggtgagcctttgtctcgcccttggttcaccaaaattacagacagttactctcgttgtatcatgggtattcatttgggctttgacgcaccaagttctcaagtggtagccctagcattacgccatgctattttgccaaagcagtatagtgcggaatacaaacttcattgtgaatgggcaacttatggtgtacctgaaaatcttttcactgatggtggtagagattttcgctcagaccacttaaaacagattggtttccaattaggttttgagtgtcatttacgcgatcgccccagtgaaggtggtattgaagaacgtagttttggcactatcaatacagaatttctctctggtttctatggctatttaggctctaatattcaggaacgccctaagacggcagaagaagaagcttgcttgactttacgggaactacacctattgttagttcgctacattattgacaactataatcagcgtcttgatgcacgtacaaaagagcaatcaaggtttcaaagatgggaagcaggattacctgctctacccaaaatggtgaaggagcgcgaattagatgtctgtttgatgaaaaaaactcgacgcagtatttacaaaggcggatatctcagctttgaaaatattatgtatcgaggagactacctagcagcttacgctggggaaagtattgtactcagatatgatcccagggatattacaagtgtttgggtttatcgaatagataaaggtaaggaagagcttctttctgctgctcatgcgttggattgggaaacagagcaattatctttagaagaggctaaagctgctagtcgaaaagtgcgttctgtgggtaaaacactcagcaataaatccattttagcagagatacacgatagagatactttcatcaagcaaaagaaaaagactcagaaggaacgcaaaaaagaagaacaggctcaagttcatcctgtttatgaatccatcaatctcagtgataccgaactggtagaaattccagaagaaacgcctaaaactcaagcaccacaatctcgaagacctagagttttcaactatgaacaactacgtcaagactatgatgagtag

SEQ ID NO: 861 - protein, 598 aa, Artificial Sequence
  Synthetic Peptide
MYPHNSELLFCLSPTMDEIPIFNQDKESLPFDDNNDLAEIQNDESEETNVIITELSAEAKLKMEVIQGLLEPCDRKTYGQKLRVAAEKLGKTVRTVQRLVKKYQQDGLSAIVDTERNDKGSYRIDPEWQKFIISTFKEGNKGSKKMTPAQVAIRVQVRAGQLGLEDYPSHMTVYRVLNPIIERKEQKQKVRNVGWRGSRVSHKTRDGQTLDVHHSNHVWQCDHTKLDVMLVDQYGEPLSRPWFTKITDSYSRCIMGIHLGFDAPSSQVVALALRHAILPKQYSAEYKLHCEWATYGVPENLFTDGGRDFRSDHLKQIGFQLGFECHLRDRPSEGGIEERSFGTINTEFLSGFYGYLGSNIQERPKTAEEEACLTLRELHLLLVRYIIDNYNQRLDARTKEQSRFQRWEAGLPALPKMVKERELDVCLMKKTRRSIYKGGYLSFENIMYRGDYLAAYAGESIVLRYDPRDITSVWVYRIDKGKEELLSAAHALDWETEQLSLEEAKAASRKVRSVGKTLSNKSILAEIHDRDTFIKQKKKTQKERKKEEQAQVHPVYESINLSDTELVEIPEETPKTQAPQSRRPRVFNYEQLRQDYDE

SEQ ID NO: 862 - DNA, 837 bp, Artificial Sequence
  Synthetic Oligonucleotide
atgaaagacgattattggcagaaatgggtacaaaatttatggggagatgaaccaattccagaggaattacagccagaaattgaacgtctactgactcccagtattgtggaattagatcatatacaaaaaatccatgattggttagatggtttgcgtctttccaaacaatgtggtcgaattgttgcacctccacgagcaggtaagtcggtttcttgtgatgtatatagactattaaataagccacaaaaaagaggaggtaaaaaagatattgtacctgttttgtatatgcaagttccaggagattgctcatcgggtgaattattagttctgattctggaaagtttgaaatatgagtcaactaccggaaaacttactgatatcagaagacgggtacaaagactactcaaagaatctaaagtggaaatgctaattattgatgaagcaaattttctcaagttgaatacttttagtgaaattgcccgaatttacgacttgctgagaatttccattgttcttgtaggtacggatggtttggataatctaattaaaaaagagccttacattcatgatcgatttattgaatgttatagattaccattagtatcagagaaaagattttctgaattagtaaaaatttgggaagaagaggttttacgtttacctctcccttctaatctcacaagaaatgaaactttattacctttgtatcaaaaaaccagtggcaaaattggtttagtagatcgggtattgagaagagcttcaattttagccttgagaaaaggattgaagaaaatagataaagagactttaactgaagttttagattggtttgaataa

SEQ ID NO: 863 - protein, 278 aa, Artificial Sequence
  Synthetic Peptide
MKDDYWQKWVQNLWGDEPIPEELQPEIERLLTPSIVELDHIQKIHDWLDGLRLSKQCGRIVAPPRAGKSVSCDVYRLLNKPQKRGGKKDIVPVLYMQVPGDCSSGELLVLILESLKYESTTGKLTDIRRRVQRLLKESKVEMLIIDEANFLKLNTFSEIARIYDLLRISIVLVGTDGLDNLIKKEPYIHDRFIECYRLPLVSEKRFSELVKIWEEEVLRLPLPSNLTRNETLLPLYQKTSGKIGLVDRVLRRASILALRKGLKKIDKETLTEVLDWFE

SEQ ID NO: 864 - DNA, 525 bp, Artificial Sequence
  Synthetic Oligonucleotide
atggaaattgctgcggatgaacctcgtttttttgaggtagaacccctggatggagaaagtttaagtcatttcttaggtcgttttcgccgagaaaattatttaacctctacccagttgggtaaattgactggactcggtgcagttattttacgttgggaaaagttgtatttcaatccttttcctactctacaagagttggaggctttgtcctctgtggtgggagttaatgtggataggttaatggagatgctcccatctcagggaatgacgatgaagcctagaccaattaggttatgtggggcttgctatgcagaatctccttgtcatcgggttgattggcagttaaaggataaaatcaggtgtgatggctacactggacgaagacatccccataatttacgcttgttaacgaagtgtactaactgtgaaacaccttttcctattcccgcagattgggtacaaggtgaatgtcctcactgtttcctgccttttgtaacaatggcgaagcgtcagaagcctagctaa

SEQ ID NO: 865 - protein, 174 aa, Artificial Sequence
  Synthetic Oligonucleotide
MEIAADEPRFFEVEPLDGESLSHFLGRFRRENYLTSTQLGKLTGLGAVILRWEKLYFNPFPTLQELEALSSVVGVNVDRLMEMLPSQGMTMKPRPIRLCGACYAESPCHRVDWQLKDKIRCDGYTGRRHPHNLRLLTKCTNCETPFPIPADWVQGECPHCFLPFVTMAKRQKPS

SEQ ID NO: 866 - DNA, 1932 bp, Artificial Sequence
  Synthetic Oligonucleotide
atgagcgttatcactattcaatgtcgtttggttgctgaagaaaacagcctccgggaactctgggaattgatgactgaaaaaaatacaccattcatcaatgaaatattggtacaggtaggaaaacacccagaatttgaaacttggctagaaaaaggtaggatacctgctgaatcactcaaaatacttggtaattccctcaaaactcaagaaccttttactggacaacctggacgtttttacacctcagcgattaccttagtggattatctgtataaatcctggtttgccttgcaaaaacgcagaaaaaaccaaatagaagggaaacagcgttggctaaaaatgcttaaaagtgatcaagaactagaacaaaaaagtcaatctagtttagaagtaattcgcactaaagctgccgaacttctgactaaatttgcacctcagtctgatagcgaagcgctccgtaggaatcaaaatgacaaccagaaaaagggaaaaaagactaaaaaatccacaaaatctaaaacatcttcaattttcaaaattcttttaaacacttacgaagaaacagaagatattcttactcattgcgctcttgcatatctactcaaaaataactgtcaaattagtgaagtggatgaaaacccagaagaatttaccagaaataagcgcagaaaagaaatagaaattgagcgattaaaagatcaactccaaagtcgcatccctaaaggtagagatttgacaggagaagaatggttagaaaccttaaaaattgccaccttaaatgttccgcaaaatgaaaatgaagcaaaagcatggcaagcagcacttttaagaaaaactgctaatgttccctttcctgtggcttatgaatcaaacgaggatatgacatggttaaaaaatgataagaatcgtctctttgtgcggttcaatggcttgggaaaacttacttttgagatttattgcgataaacgtcatttgcactacttccaacgcttcctagaggatcaagaaattaaacgcaatagtaaaaatcaacattcaagtagtttgtttactctacgctcaggaagaatttcttggttgccaggtgaagaaaaaggtgaacattggaaagtaaatcaactaaatttttattgttctttagatactcgaatgatgacttatgaaggaactaaacaggtagttgaggagaaagttacagcaattaccgaaattttaaataaaaccaaacagaaagatgatctcaacgataaacaaaaagcctttattactcgtcagcaatcaaccctagctcgaattaataatccttttcctcgccccagcaaacctaattatcaaggtaaatcttctatcctaataggtgttagttttggactagaaaaaccagttacagtggcagtggtagatgttgttaaaaatgaagttatagcttatcgcagtgttaaacaactacttggggaaaactataatttactaaatcgtcagcgacaacaacagcaacgcctatctcacgaacgccacaaagcccaaaaacaaaatgcacccaactcttttggtgaatcagaattagggcaatatgtggatagattattggctgatgcgataattgcgatcgccaaaacttatcaagctagtagtattgttttaccaaaactccgcgatatgcgagagcaaatcagcagtgaaattcaatccagagcagagaacagatgtcctggttctaaggaaggacaaaaaaaatatgctaaagaatatcggattaacgttcatcgctggagttatggacgattaatcgagagtatccaatcccaagcagcacaagctggaattgcaattgaaactgggacacaatcaatcagagctagtccacaagaaaaagcgcgagatgtagctgtttttgcttaccaaaaacgtcaaactattaagtcagtctaa

SEQ ID NO: 867 - protein, 643 aa, Artificial Sequence
  Synthetic Peptide
MSVITIQCRLVAEENSLRELWELMTEKNTPFINEILVQVGKHPEFETWLEKGRIPAESLKILGNSLKTQEPFTGQPGRFYTSAITLVDYLYKSWFALQKRRKNQIEGKQRWLKMLKSDQELEQKSQSSLEVIRTKAAELLTKFAPQSDSEALRRNQNDNQKKGKKTKKSTKSKTSSIFKILLNTYEETEDILTHCALAYLLKNNCQISEVDENPEEFTRNKRRKEIEIERLKDQLQSRIPKGRDLTGEEWLETLKIATLNVPQNENEAKAWQAALLRKTANVPFPVAYESNEDMTWLKNDKNRLFVRFNGLGKLTFEIYCDKRHLHYFQRFLEDQEIKRNSKNQHSSSLFTLRSGRISWLPGEEKGEHWKVNQLNFYCSLDTRMMTYEGTKQVVEEKVTAITEILNKTKQKDDLNDKQKAFITRQQSTLARINNPFPRPSKPNYQGKSSILIGVSFGLEKPVTVAVVDVVKNEVIAYRSVKQLLGENYNLLNRQRQQQQRLSHERHKAQKQNAPNSFGESELGQYVDRLLADAIIAIAKTYQASSIVLPKLRDMREQISSEIQSRAENRCPGSKEGQKKYAKEYRINVHRWSYGRLIESIQSQAAQAGIAIETGTQSIRASPQEKARDVAVFAYQKRQTIKSV

SEQ ID NO: 868 - DNA, 1680 bp, Artificial Sequence
  Synthetic Oligonucleotide
atgctggacgatcataccaatagcgagcaagaggcagaaaaggatgagatcgtgacggaactctcagcagctgataggcatttgctggatatgattcagcaactactagaaccgtgcgatcgcatcacctatggagaaagacaaagggaggtcgcagccaaactaggcaagtctgtgcgaacggtacggcgactggtaaaaaaatgggaagaggaaggtttagctgcacttcaaactacgacacgggctgacaaaggcaaacatcgaatagacactgattggcaacagttcatcatcaaaacttataaggaaggcaataaaggtagtaagcgaattactccccaacaagtggcaatcagagtacaagcaagggcggctgaattaggacaaaaaaaatatcccagctataggactgtgtatcgagttctacaacccattattgagcagcaagaacaaaaagcaggtgttagaagtcgaggttggcatggttctcgattatcagttaaaacccgcgatggtaaagacttatcagtagaatatagcaaccatgtttggcagtgtgaccatactcgtgtagacctattgctggtagatcagcatggtgaacttttggctcgtccttggctgacaactgttgttgatacttactcccgttgcatcatggggataaacttaggctttgatcctccgagttctcaggtagtagcattagcactgcgccatgcaattttgccaaagcagtatgggtcagaatatggacttcatgaagaatggggaacctacgggaaaccagaacatttttataccgatggtggtaaagattttcgctcaaaccatttgcaacagataggtgtgcaattgggatttgtttgtcatttacgcgatcgccccagtgaaggtggtattgttgagcgtccttttggcacttttaataccgacttcttttctaatatgccgggatacacaggatcaaatgtgcaggaacgtccagagcaagctgagaaggaggcttgtctgactttacgggagttggaacataggtttgtacgctacatcgtggataaatataaccagcgtcctgatgcgcgtcttggcgatcaaactcgctatcaacgatgggaagcagggttaattgcttctcctaatgtaatttcagaagaggagttacgtatttgcctgatgaagcaaactcgacgctctatttatagaggtggatatctgcaatttgaaaatctgacgtatcggggagaaaatttggcaggttatgcaggtgaaagcgttgtactgcgctatgaccccaaagacattacaactgtgttggtttaccgccaaagtggtaataaagaagagtttttagctagggcatttgctcaggagttggagactgagcaattatctttggatgaggctaaagctagtagtcgtaagattcggcaagcagggaagatgattagcaatcgctcaatgttggcagaggtacgcgatcgcgaaactttcctgacccaaaagaaaaccaaaaaggaacgtcaaaaagcggaacaggctgtagtacaaaaagctaaacaaccattgatagttgaaccagaagaaattgaagtggcattgtttgatagtgagccagaataccagatgccagaggcctttgattacgaacaaatgcgtgaagattacgggtggtaa

SEQ ID NO: 869 - protein, 559 aa, Artificial Sequence
  Synthetic Peptide
MLDDHTNSEQEAEKDEIVTELSAADRHLLDMIQQLLEPCDRITYGERQREVAAKLGKSVRTVRRLVKKWEEEGLAALQTTTRADKGKHRIDTDWQQFIIKTYKEGNKGSKRITPQQVAIRVQARAAELGQKKYPSYRTVYRVLQPIIEQQEQKAGVRSRGWHGSRLSVKTRDGKDLSVEYSNHVWQCDHTRVDLLLVDQHGELLARPWLTTVVDTYSRCIMGINLGFDPPSSQVVALALRHAILPKQYGSEYGLHEEWGTYGKPEHFYTDGGKDFRSNHLQQIGVQLGFVCHLRDRPSEGGIVERPFGTFNTDFFSNMPGYTGSNVQERPEQAEKEACLTLRELEHRFVRYIVDKYNQRPDARLGDQTRYQRWEAGLIASPNVISEEELRICLMKQTRRSIYRGGYLQFENLTYRGENLAGYAGESVVLRYDPKDITTVLVYRQSGNKEEFLARAFAQELETEQLSLDEAKASSRKIRQAGKMISNRSMLAEVRDRETFLTQKKTKKERQKAEQAVVQKAKQPLIVEPEEIEVALFDSEPEYQMPEAFDYEQMREDYGW

SEQ ID NO: 870 - DNA, 840 bp, Artificial Sequence
  Synthetic Oligonucleotide
atgacttcaaaacaagctcaagcagttgcccaacaattaggtgaaatttcagccaatggtgaaaaattacaagcagaaattcaaagattgaaccggaagacttgtatcctcttggagcaagttaaaattcttaatgactggctagaaggaaagcgtcaagcacgtcagtctggtcgtattgtaggagagtccagaactggtaaaacaatgggttgtgatgcctacagactccggcataaacccaagcaagaggtaggaaaaccaccattcgtgcctattgcttttctcgaagacattccgtctgattgtagtgctaaagatttgttcaatgagattcttaagcatttaaagtatcagatgaataagggaactgtagctgagattagagaacgcacatttcgagttcttaaaggttgcggggttgagatgctgatcattgatgaagctgaccgcttgaaacccaaaacttttgctgaagtgcgagatatttttgacaagttagaaattgcggtgattttggtgggtactgacagattagacgctgtaatcaagcgagatgagcaagtttataaccgctttcgtgcctgtcatcggtttggtaagttttctggtgaagattttaagcgaactgtggagatttgggaaaagcaagttttaaaactgccagttgcttctaatctttccagcaagacgatgctaaaaactttaggtgaggcaacggggggttatattggtttgctagatatgattttgagagaatcagcaattcgggcgttaaagaaaggattacagaaagttgatttggagacgctgaaggaagttacggcggagtacaagtaa

SEQ ID NO: 871 - protein, 279 aa, Artificial Sequence
  Synthetic Oligonucleotide
MTSKQAQAVAQQLGEISANGEKLQAEIQRLNRKTCILLEQVKILNDWLEGKRQARQSGRIVGESRTGKTMGCDAYRLRHKPKQEVGKPPFVPIAFLEDIPSDCSAKDLFNEILKHLKYQMNKGTVAEIRERTFRVLKGCGVEMLIIDEADRLKPKTFAEVRDIFDKLEIAVILVGTDRLDAVIKRDEQVYNRFRACHRFGKFSGEDFKRTVEIWEKQVLKLPVASNLSSKTMLKTLGEATGGYIGLLDMILRESAIRALKKGLQKVDLETLKEVTAEYK

SEQ ID NO: 872 - DNA, 507 bp, Artificial Sequence
  Synthetic Oligonucleotide
atggaagttgtagaaattcaaccttggctgtttcaaatagaacctttacagggagaaagtttgagtcactttttagggcgttttcgacgggcaaatgatttaacgcctactggattaggtaaagccacaaaacttgggggtgcgatcgcccgatgggaaaaatttcggtttaatcccccaccgtctcgccagcaattagaggcattggctaaggttgtagaggttgatgctgataggctagcgcagatgttaccgcctgctggggtggagatgaagcttgagccgattcggttatgtgctgcttgttatgttgagtcagcttatcataagattgaatggcagttgaagataacgcaagggtgcgatcgccaccaattaattttgttgtcagaatgtccaaactgtggggcaagatttaaggttccagcagtgtgggcggatggttggtgtcaacggtgttttctgagttttgccgagatggtaaagtatcaaaagtcttatcgatga

SEQ ID NO: 873 - protein, 168 aa, Artificial Sequence
  Synthetic Peptide
MEVVEIQPWLFQIEPLQGESLSHFLGRFRRANDLTPTGLGKATKLGGAIARWEKFRFNPPPSRQQLEALAKVVEVDADRLAQMLPPAGVEMKLEPIRLCAACYVESAYHKIEWQLKITQGCDRHQLILLSECPNCGARFKVPAVWADGWCQRCFLSFAEMVKYQKSYR

SEQ ID NO: 874 - DNA, 1911 bp, Artificial Sequence
  Synthetic Oligonucleotide
atgagccaaatcactattcagtgtcttcttgtagccttagagtcatcacgccagcaactatggaagttgatggctgagttaaatacgccattgattaatgaactactacgtcaggtaagtcaacacccagagtttgagacttggcgacaaaagggcaaacaccccactagtattgtcaaaggactctgccaacctttgaaaactgaccctcgctttatcggtcagcctggacggttttatacgagtgcgatcgcattggtgaactacatctataaatcatggtttgccctaatgaagcgatcgcagttccaactagaaggcaaaattcgctggttggaaatgctcaacagtgatgttgaattgctagaaagtagtggtgtcagcttagatagtcttcgcactaaagctgctgaaattttggctcaattttcttctctcaatactgctgaaactccatcaacaaatgtaaaaaaagctaaaaagcgcaaaaaagctcaaaactcagatagcgatcgcaatttatcaaagaatttatttgagacttaccgcaatacagaagataacttgactcgttgcgccatcagctatttgctcaaaaatggttgcaaaataaacgataaagaggaagacgctaaaaaatttgctcaacgtcgccgtaaacttgaaattcagattgaacgcatcagagaacagctagaaacacgaattcccaaaggtcgagatttaaccgttatcaaatggttagaaactattgttgttgccactcacaccgttccaacaaatgaagccgaggcaaaatcttggcaagacagccttttaaggcaatctagcaaagtacctttcccggtagcttacgaaagcaacgaagacatgacttggtttaaaaaccagtttgggcgtatctgtgtaaaattcaacggtttgagtgagcatagttttcaagtctattgtgattctcgccaccttcactggtttcaacgcttcctagaagatcaacaaattaagaaaaatagtaaaaaccagcactctagtagcctgttcaccctgcgtagtgggcgtattgcttggcaagaagaggaaggcaaaggcgatccttggaatgttaatcgcttaaccctctactgttctgtggatacacgcctatggacgactgaaggaaccaatcaagtaagggaagagaaagctgaagaaatcgctaaaattatcactaatacaaaagccaaaggcgaccttaatgaaaaacagcaagcccacataaaacggaaaaactccaccttagacagaattaataacccttttcctcgccccactaaacctttatataaaggacaatctcatattcttattggtattagcctcggcttagaaaagcctgcaacgctagcggtagtagacggcactacaggtcaagtaattacctatcgcagcatcaaacaactactgggtgataattacaaactgctaaatcgacagcgacagcaaaagcattttttatcccaccaacgccaaatagctcaaacgcttgctgcaccaaatcagtttggagaatcggagttaggggagtatattgacagattactagcgaaagagattattgcgatcgcccaaacatactctgctggaagtattgttctacctaagttggacaatatgcgagagcaagttcaaagtgaggttcaagccaaaactgaacaaaaatcagacttaatagaagttcaacaaaagtatgctaaacagtaccgagttagcgtccatcagtggagttatggcagattgatggcaaatattcactcgtcagctgttaaagctggaattgtgatagaggagtcaaaacagccaattcgaggtagtccacaagagaaagcgaaagaattagcgatctccgcttaccattcccgcaaaataaactga

SEQ ID NO: 875 - protein, 636 aa, Artificial Sequence
  Synthetic Peptide
MSQITIQCLLVALESSRQQLWKLMAELNTPLINELLRQVSQHPEFETWRQKGKHPTSIVKGLCQPLKTDPRFIGQPGRFYTSAIALVNYIYKSWFALMKRSQFQLEGKIRWLEMLNSDVELLESSGVSLDSLRTKAAEILAQFSSLNTAETPSTNVKKAKKRKKAQNSDSDRNLSKNLFETYRNTEDNLTRCAISYLLKNGCKINDKEEDAKKFAQRRRKLEIQIERIREQLETRIPKGRDLTVIKWLETIVVATHTVPTNEAEAKSWQDSLLRQSSKVPFPVAYESNEDMTWFKNQFGRICVKFNGLSEHSFQVYCDSRHLHWFQRFLEDQQIKKNSKNQHSSSLFTLRSGRIAWQEEEGKGDPWNVNRLTLYCSVDTRLWTTEGTNQVREEKAEEIAKIITNTKAKGDLNEKQQAHIKRKNSTLDRINNPFPRPTKPLYKGQSHILIGISLGLEKPATLAVVDGTTGQVITYRSIKQLLGDNYKLLNRQRQQKHFLSHQRQIAQTLAAPNQFGESELGEYIDRLLAKEIIAIAQTYSAGSIVLPKLDNMREQVQSEVQAKTEQKSDLIEVQQKYAKQYRVSVHQWSYGRLMANIHSSAVKAGIVIEESKQPIRGSPQEKAKELAISAYHSRKIN

SEQ ID NO: 876 - DNA, 1755 bp, Artificial Sequence
  Synthetic Oligonucleotide
atgattcaagacttgcaacagcctttgatattagacgaaaacaacaatcatcttaatattcagctagatgaaaagcctgtaaaacctcaaagactaccctctgacgaattgcttactgacaaagtaaaccgcaggatagaggtgcttcaaagccttatcgagccatgcgatcgcaaaacctacggtattaaaaagcgggaggctgcgcgaaaactgggtgtatcgctgcgtcaggtagaacgcttgcttcagaagtggcgagaacatgggttagttggactaactgcaacgcgatcagataaaggaaagtaccgccttgagcaggattgggtagactttatcatcaatacttataccaacggtaacaagggcagcaagcggatgactcggcatcaagtatttatgcgggtcaaaggaagagctaagcaactcgcgctgaaaaaaggtgaatacccaagtcaccagtcggtttatcgaattctcgaccaacacatcgagcagaaagacagaaaacggaaagcaagaagcccaggctactcaggagagcggttgacacacatgactcgtgatgggcgagagttggaggtcgagggtagcaatgacgtatggcagtgcgatcatactcgcttagatatcaggcttgttgacgagtatggcgttctggatcgcccttggctaacgataatcatcgattcctattcccgttgcgtgatgggattttatttaggattcgatcaccctagctctcaaattgatgccttagctttgcgtcatgcaatcctacctaagtcttatggttctggatatcaacttcgtcacgactgggggacatatggtaaacccaatcacttttatactgacggcggtaaggactttacttcaattcacattacagagcaagttgccgttcaaataggtttcaattgctctttgagaagacgaccatcagatggtggaattgtcgagcgtttttttaggacgcttaacgaccaagtattgcgtgatttaccaggctacacggggtcaaacgtgcaacaacgcccagcaaccgtggataaagatgctcgcctgactctcaagggtttagaaacgattttagtgcgttacatagtagatgaatataaccagcacgtagatgcccgttctggaaaccagagtcggttgcagcggtgggaaggcggattaatggtagatccttatctatacgatgaattggacttggcaatttgcttgatgaagcaagagcgccggacagtccagaaatacggacgaataagatttggagatcgggattttgcagcagaacatttaagaggtcgagcaggagaattggttacagtacgattcgatcctgatgacatcactactctcttcgtctatcaacgcaatgcagatggtacggaagaattactcgattatgctcacgctctagatttagaaactgaacggctttctttacgagaactgaaagcgagaaataagaagcgtagagaaacaggtgaggaaatcaacaattcgattttagacgcgatgctagatcgtgacgaatttgtggaaaatttagttaaaagaaaccgtcagcagcgcaagcaggcagcgcaggaacaagtaaatcccacacagtctgttgctaagaaatttgctatttccaaaccagaagaaatagaggcaaagtctatgtcagaagcagaactggaagtagagctaccaagatatcaagttcgcttcatggacgacttgtttgaagatgattag

SEQ ID NO: 877 - protein, 584 aa, Artificial Sequence
  Synthetic Peptide
MIQDLQQPLILDENNNHLNIQLDEKPVKPQRLPSDELLTDKVNRRIEVLQSLIEPCDRKTYGIKKREAARKLGVSLRQVERLLQKWREHGLVGLTATRSDKGKYRLEQDWVDFIINTYTNGNKGSKRMTRHQVFMRVKGRAKQLALKKGEYPSHQSVYRILDQHIEQKDRKRKARSPGYSGERLTHMTRDGRELEVEGSNDVWQCDHTRLDIRLVDEYGVLDRPWLTIIIDSYSRCVMGFYLGFDHPSSQIDALALRHAILPKSYGSGYQLRHDWGTYGKPNHFYTDGGKDFTSIHITEQVAVQIGFNCSLRRRPSDGGIVERFFRTLNDQVLRDLPGYTGSNVQQRPATVDKDARLTLKGLETILVRYIVDEYNQHVDARSGNQSRLQRWEGGLMVDPYLYDELDLAICLMKQERRTVQKYGRIRFGDRDFAAEHLRGRAGELVTVRFDPDDITTLFVYQRNADGTEELLDYAHALDLETERLSLRELKARNKKRRETGEEINNSILDAMLDRDEFVENLVKRNRQQRKQAAQEQVNPTQSVAKKFAISKPEEIEAKSMSEAELEVELPRYQVRFMDDLFEDD

SEQ ID NO: 878 - DNA, 801 bp, Artificial Sequence
  Synthetic Oligonucleotide
atggaagatttaagtccagaaatccagaagaaaattaaagacttaagccgcccaccatacttagaattagaacgagtcaaacactgtcatgcatggttgacagagttacttatatcaaggatgactggtctattggtaggagagtctcgttgcggaaaaactgttacttgtaaagcttttacaaagcaatacaacgagttgaaaaaaacacagggacagcggtttaagccagtagttcacattcaaattcctaaagcttgtggttctagagatttctttatcaaaatcctcaaagctctaaataagcctacaaatggaaccatttcagacttacgagagcgaacgcttgatagcttggaaatacatcaagtagaaatgctaattattgacgaagccaatcacctgaaatacgaaacgttttctgatgtacgacatatttatgacgaaaatggattgggaattgccgttctcctagtcggtactaccagccgtctccatgcaatagttaagcgcgatgagcaagttctcaatcgttttctagagcaatatgaattagatcgcttagacgagtcccagtttaagcaaatcgtacagatttgggagcgagatgttctgaatttgccagtagcatccaacttagcaacaggagaaaatctaaagcttttgaagcagggaactcagaaattaattggtcgcctagatatgctccttcgcaaagcagcaattcgctcgttacttagagggcatcaaaacctagacaaagacgttttgaaagaagtaattactgcaactaagtggtga

SEQ ID NO: 879 - protein, 266 aa, Artificial Sequence
  Synthetic Peptide
MEDLSPEIQKKIKDLSRPPYLELERVKHCHAWLTELLISRMTGLLVGESRCGKTVTCKAFTKQYNELKKTQGQRFKPVVHIQIPKACGSRDFFIKILKALNKPTNGTISDLRERTLDSLEIHQVEMLIIDEANHLKYETFSDVRHIYDENGLGIAVLLVGTTSRLHAIVKRDEQVLNRFLEQYELDRLDESQFKQIVQIWERDVLNLPVASNLATGENLKLLKQGTQKLIGRLDMLLRKAAIRSLLRGHQNLDKDVLKEVITATKW

SEQ ID NO: 880 - DNA, 519 bp, Artificial Sequence
  Synthetic Oligonucleotide
atggctaaaacacttaaagaaacaaaactctggctgacacgagttgagccattagaaggggaaagtattagtcactttttgggtcgctttcgacgagcaaaaggaaataagttctcgactccgtgtggtttaggtcaagtgtcaggacttggagcagtgttggctcgttgggaaaagttttatttcaatccctttccaacatttgaggagttagaggcgctagcaaatgtggtggaagtcgatgttaatagactgcgagaaatgctgcctttagctggtgtagggatgaaacataaaccaattagattatgcggagcttgctatgcagaagaaccctatcatctgattgcatggcagttcaagactacagcaggatgcgatcgccaccagttgcgcttgctatctaaatgcccaatctgtgaaaaaccgtttcctattcccgctttatggatagaaggacgatgcctgcgttgtttgacgttttttgccgagatggtcgatcgccaaaaagcttactag

SEQ ID NO: 881 - protein, 172 aa, Artificial Sequence
  Synthetic Peptide
MAKTLKETKLWLTRVEPLEGESISHFLGRFRRAKGNKFSTPCGLGQVSGLGAVLARWEKFYFNPFPTFEELEALANVVEVDVNRLREMLPLAGVGMKHKPIRLCGACYAEEPYHLIAWQFKTTAGCDRHQLRLLSKCPICEKPFPIPALWIEGRCLRCLTFFAEMVDRQKAY

SEQ ID NO: 882 - DNA, 1914 bp, Artificial Sequence
  Synthetic Oligonucleotide
atgagtcagattactattcagtgtcgtcttgttgctacagaatcagcccgccaacagatgtggaggttaatggcagaaatcaacacgccattaattaatgaactactcgcgcaagtcggtcaacaccctgacttcgagcagtggcgacaaaaaggcaagcttccatctactttcattagccagctatcccagtcattcaagtccgatccccgttttttaggtcaacccagccgtttttacaaatctgcttttaatgctgtggaatacatctacaagtcctggttagctctaaataaacggctacagcagcagttagacagaaaaaggcgatggctagaaatactccagagcgatactgaattagcggcagatagtaattgcagtttggatgctattcgcagtaaagctgctgaaattctctctcaagctatacaagcacctagcttggattcttccccacctagaggtaaaaagggtaaaaagtctaaaggaagatcctcttcaagccctgtctctagcctgtttgctaatttgtttaaggcttatcaagagacagatgacattaaatgccgctgcgctatcagctatttgctgaaaaataactgtcaactcagcgatcgcgaagaagatccagagaaatttgctaaacgtcgccgtaaagttgaaatccggattcaacgtcttactgaaaagctaaacagcaggatgccgaacggtcgagatttgaccaatactaggtggctggagacattggctattgccacaacctctgttcctcaagacgaagcccaagccagacagtggcaagatgttctattaaccaaaccgaagtctctcccatttccactaatttttgaaactaacgaagacctattttggtcaaaaaaccagcaagataggctctgcgttcacttccctggcttaagggatttggctttccaagtatattgcgatcgccgtcagcttcactggtttcatcgctttctagaagaccagcagactaaacatagcagcaaaaatcagcattctagtagcttgttcactttgagaagtgcttatctagcttggcaacaaggcaaggagaagggcgaaccttggaatacccactacctaattttgtattgttgtgttgatacccgcttatggactgctgaaggaactgagctggtacgtcaagaaaaaactgcggaaattgagaaagttatcaatagaaccaaggcgaagaacgatctaactgagacgcagcaagcctttattcaacgtcaaaaatccacgttagctcgaattaagggtcatttcgatcgccctagccaatctatctaccaaggtcaatctcatattttagttggagtgagcctgggactagacaaacctgctacagtagccgtagtagatgcgatcgcagaaaaagtcctcgcttaccgtaatactcgacaactacttggtgacaattataaactgctcaaccgccagagaaggcagcagcggtccttgtctcacaagcgccataaagctcaaaaacgtgctgacaccaatcaatttggggaatccgaattagggcagtatgtagagcgattattggcaaaagagattgtggcgatctcgcaaaattatcgagcggggagcattgttctgcctaaactaggcgatatgcaggagattctgacaagcgagattcaggctagagcagaagctaaatgtcctaactatgttgaaggacagcaaaagtatgccaagcagtatcggattagcatccataagtggagttacggcagattaatgcaaaacattcagagccaagcagctcaagctgaaattgttgttgaagaaggaaaacaactgattcgaggcagtccgcaagaaatggcaaaagaattagcgatcgctgcttaccaatctcgtcagcctcagtaa

SEQ ID NO: 883 - protein, 637 aa, Artificial Sequence
  Synthetic Peptide
MSQITIQCRLVATESARQQMWRLMAEINTPLINELLAQVGQHPDFEQWRQKGKLPSTFISQLSQSFKSDPRFLGQPSRFYKSAFNAVEYIYKSWLALNKRLQQQLDRKRRWLEILQSDTELAADSNCSLDAIRSKAAEILSQAIQAPSLDSSPPRGKKGKKSKGRSSSSPVSSLFANLFKAYQETDDIKCRCAISYLLKNNCQLSDREEDPEKFAKRRRKVEIRIQRLTEKLNSRMPNGRDLTNTRWLETLAIATTSVPQDEAQARQWQDVLLTKPKSLPFPLIFETNEDLFWSKNQQDRLCVHFPGLRDLAFQVYCDRRQLHWFHRFLEDQQTKHSSKNQHSSSLFTLRSAYLAWQQGKEKGEPWNTHYLILYCCVDTRLWTAEGTELVRQEKTAEIEKVINRTKAKNDLTETQQAFIQRQKSTLARIKGHFDRPSQSIYQGQSHILVGVSLGLDKPATVAVVDAIAEKVLAYRNTRQLLGDNYKLLNRQRRQQRSLSHKRHKAQKRADTNQFGESELGQYVERLLAKEIVAISQNYRAGSIVLPKLGDMQEILTSEIQARAEAKCPNYVEGQQKYAKQYRISIHKWSYGRLMQNIQSQAAQAEIVVEEGKQLIRGSPQEMAKELAIAAYQSRQPQ

SEQ ID NO: 884 - DNA, 1692 bp, Artificial Sequence
  Synthetic Oligonucleotide
atgttaaaactatctgaagataatcacggcgacaatcaaaagccagaagtcggcgagattgtggctgaaatagcagatgataataagcaactgctggaaataattcagaagttgctggagccttgtgatcgcattacctacggacaacggcaaagggaagctgccgctcagttaggaaagtcagtgcggacagtgcgacgactagtcaaaaagtgggaagaggaaggtttggctgctttatcgcaaacgacacgagaagataaaggcaagcatcgaatcgagcaagactggcaagatttcattattaaaacttataaggagggtaataaaggtagtaagcgcattacccccaaacaagttgctgttcgcgtacaggcaaaggcagctgaactaggacaagatcgatatcccagttacagaacggtatatcgcgtcctacaaccgattattgagcggcaagagcaacaggcaagcattagaagtcggggctggcgaggttcgcgtttgtcagtcaaaactcgtgatggtaaagacttatcagtggagtacagcaatcacgtttggcagtgcgaccacactcgcgtagacgtgctgctagtagatcgaaatggtgaacttttaagtcgcccttggctgacgacagttatagacacttactctcgttgcatcatgggctttaacttaggctttgctgcaccgagttctcaggtagtggcactggcgctgcgtcatgccattttgccaaagcggtatgattcgcaataccaactccattgtgacgcgggaacctacggtaagccagaacacttttacactgacggcggcaaagattttcgctccaaccatttgcagcagattagtgtgcagttaggatttgtttgtcatttacgtgatcgccctagtgaaggtggcattgttgagcgtccatttggcactttgaacacagaattattttcaactttgccaggatacacggggtcaaacgtacaagaacgcccagagcaagctgagaaagaagcttgtttaaccttaagggagttagatcgtttgctagtgcgctacatcgtggataaatacaaccaaagtattgatgcgcgtctgggagatcaaactcgctttcagcgttgggaagctgggttaattgctgctcccaatcccattgcagagcgagatatggatatttgtctaatgaagcaaactcggcgctcaatctatcgaggtggatatctgcaatttgaaaacctgatatatcggggagaaaatatggctggttatgcaggcgaaagtgttgtgcttaggtatgaccccaaagatatcactaccgtcttaatttataggcaagaagctggtgaagaggtgtttttagctagagcatttgctcaggatttggaaacagaacaaatgtctctagatgaagcaaaagctagtagccgcaagcttcgagagacaggaaagacgattagcaatcgctcaattttggcagaagtgcgcgatcgcgaaacctttttaactcaaaagaaaactaaaaaggaacgtcaaaaagcagaacaggctgaagttcaaagggttaaacaaccattgtctatcgaccctgaagaagaaatagaagcggcatcgattccaaatcaagcagagccggagatgccagacatatttaactacgaacaaatgctcgaagattacgggttttag

SEQ ID NO: 885 - protein, 563 aa, Artificial Sequence
  Synthetic Peptide
MLKLSEDNHGDNQKPEVGEIVAEIADDNKQLLEIIQKLLEPCDRITYGQRQREAAAQLGKSVRTVRRLVKKWEEEGLAALSQTTREDKGKHRIEQDWQDFIIKTYKEGNKGSKRITPKQVAVRVQAKAAELGQDRYPSYRTVYRVLQPIIERQEQQASIRSRGWRGSRLSVKTRDGKDLSVEYSNHVWQCDHTRVDVLLVDRNGELLSRPWLTTVIDTYSRCIMGFNLGFAAPSSQVVALALRHAILPKRYDSQYQLHCDAGTYGKPEHFYTDGGKDFRSNHLQQISVQLGFVCHLRDRPSEGGIVERPFGTLNTELFSTLPGYTGSNVQERPEQAEKEACLTLRELDRLLVRYIVDKYNQSIDARLGDQTRFQRWEAGLIAAPNPIAERDMDICLMKQTRRSIYRGGYLQFENLIYRGENMAGYAGESVVLRYDPKDITTVLIYRQEAGEEVFLARAFAQDLETEQMSLDEAKASSRKLRETGKTISNRSILAEVRDRETFLTQKKTKKERQKAEQAEVQRVKQPLSIDPEEEIEAASIPNQAEPEMPDIFNYEQMLEDYGF

SEQ ID NO: 886 - DNA, 837 bp, Artificial Sequence
  Synthetic Oligonucleotide
atgagttcaaaagaagcgcaagctgttgctcaagagttgggagatattcaacccaatgatgcgagattgcaaaccgaaattcagcgattgaatcgtaaaagttttgtccctctagaacaagtaaaaattcttcatgactggttagacggaaaacgtcaagcacgacagggttgtcgagtcgtaggagagtcgcgcacaggaaaaactattgcttgtgatgcttatagattgaggcacaagccaatacaagaaccaggaaagccacctattgtacctgttgtttatatcctagtacctccagactgcggttctaaagacttatttaggttaattattgagtatctgaaatatcagatgactaagggaacagtagctgaaattcgagagcgaactcggcgggttttgaagggttgtggagtagagatgttaatcattgatgaggctgaccgtttaaagccaaatacatttaaagatgtgcgagatattggtgaagatttgggaattacagttgttttagtaggaactgaccgtttagatgcagtgattaaaccagactcccaagtttacaaccgctttcgtgcttgtcatcggtttggtaatttatcgggtgatagttttaaaagaacagtggagatttgggaaaagaaggttttgcaattgcctgttgcatcaaatctttctagtaaaacaatgttgaagacgttgggcgaagcaacgggaggttatatcggtttgctggatatgattttgagagagacagcaattcgatgtctgaagaaaggattgcccaaaatcgacttagaaacgctgaaggaagtggctggagaatataggtaa

SEQ ID NO: 887 - protein, 278 aa, Artificial Sequence
  Synthetic Peptide
MSSKEAQAVAQELGDIQPNDARLQTEIQRLNRKSFVPLEQVKILHDWLDGKRQARQGCRVVGESRTGKTIACDAYRLRHKPIQEPGKPPIVPVVYILVPPDCGSKDLFRLIIEYLKYQMTKGTVAEIRERTRRVLKGCGVEMLIIDEADRLKPNTFKDVRDIGEDLGITVVLVGTDRLDAVIKPDSQVYNRFRACHRFGNLSGDSFKRTVEIWEKKVLQLPVASNLSSKTMLKTLGEATGGYIGLLDMILRETAIRCLKKGLPKIDLETLKEVAGEYR

SEQ ID NO: 888 - DNA, 513 bp, Artificial Sequence
  Synthetic Oligonucleotide
atgaaagctacagacattcagccttggctatttcgagtagaaccctatgagggagaaagtttgagtcattttttggggaggtttcgacgagcaaatgacttaacgcctactgggttaggtaaggcagtaggagttgggggagcgatcgcacgttgggaaaagtttcgttttaatccacccccctcggaaatggagttggagaagttagcgcaggtggtaaagattgatgtgagtagattaagagagatgttaccaccaccagaaattgggatgaagatgaatccgattcgcttgtgtggggcgtgttgtggagaaatgctctgtcataagattgagtggcagttgaagacaacgaagttttgtagcaagcatgggctaactttgctgtcggaatgtcctacttgtgggtcgagatttgcgtttccggcgttgtggaatgagggatggtgtaagcggtgttttttgccgtttggggaaatggtgcagtatcaaaaattagctcaaaagtcatag

SEQ ID NO: 889 - protein, 170 aa, Artificial Sequence
  Synthetic Peptide
MKATDIQPWLFRVEPYEGESLSHFLGRFRRANDLTPTGLGKAVGVGGAIARWEKFRFNPPPSEMELEKLAQVVKIDVSRLREMLPPPEIGMKMNPIRLCGACCGEMLCHKIEWQLKTTKFCSKHGLTLLSECPTCGSRFAFPALWNEGWCKRCFLPFGEMVQYQKLAQKS

SEQ ID NO: 890 - DNA, 1923 bp, Artificial Sequence
  Synthetic Oligonucleotide
atgtgtacaattaaatgcatgagccaaatcacaattcagtgccgctttatctcatctgaatctacacgccaccgaatctgggaattgatggcagagaaaaacacgcctctgattaatgaattgctagaacaagttggtcagcatcctgagttcgagacttggcgacaaaagggcaaacttccatctgggattgtcagtaaactgtgtcagccgctcaaaaaagaggagcgcttcattggtcagcccagtcgtttgtatatatcagccattcatgttgtggactacatctacaagtcttggctggctttgcagctaaggttacagcgaaaattagagggacaaactcgctggctagagatgctcaaaagtgattctgaactaatcgaagtaactggttgcagcttagatgctattcgcacccgtgccgctgaaattttggctcaatctgcctctcaatctgatccagtcacaaggcagcaaactcaagacaaaaaaaagaaaaaatttaaagctaaaaattctaacactagcctcagtaatacattatttgaaatttatcggaacacagaagacatcctgactcgctcctacatcagctatttgctcaaaaacggttgcaaagtgagcgacaaggaagaagacgcagaaaaatttgccaagcgtcgccgtaaagttgaaattcgcgttgaacgtcttcaagagcagctgaaaagccggatgcccaaaggtcgggacttgacaagcgatcactggctggagacattagtgatcgctacccataatgtccctaaaaatgaagatgaggctaaatcttggcaagccagccttttgagaaaatctagttctgtgccatttcctctagtttacgaaactaacacagacttaacttggttcaaaaaccagaaaggtcgtatctgtgttaatttcagtggcttaagcgaacatacctttgaaatatattgtgattcgcgccaacttcactggttcaaacgctttctagaagaccaacaaattaaacacgacagtaaaaatcagcactctagcagtttgtttaccctccgctctgcgcggctcaattggcaggaaggtgaaggaaagggcgaaccctggaacgtccacagattaactttctactgcacagttgacacgcgattgtggacaaatgagggaacagaacaggtgcgcgaagagaaagcatttgagatcgctagaactctgactcggatgaaagaaaagggtgacataaacaagaatcagcaagcttttgtcaagcgcaagcattctaccttggctcgaattaataatccctaccctcgacctagccagcccctttacaaaggtcaatctcacattctggttggtgtcagtcttggtcttgataaacctgcaacagtagccgtagtagatgctactacaggtgaagttttcacataccagagtattcgacagttacttggtgacaattacaaattactgaaccgcgaacgaaaacaacagcaaagtaaatctcaccaacgtcataaagctcaaaaaagtgctgcgcccaactcgtttggggaatcagagctagggcagtatgtagaccgattgcttgctaaagcaattgttgcgatcgctcaaacttatcaagctagcagcatcgttctacctaaaataggcgatatgcgggagattgttcaaagcgaaattcaagccagagcagaagctaaatgctctgttattgaaggtcagaaaaagtatgcaaaacaataccgctgtagtgttcacaaatggagctacggcagattgattgagagcattcagagccaagcagcaaaaactggaattgccattgaagaagggcagcaaccgattcgaggcagcccacaagaacaagcacgggagttggcgatcatagcctataagtcccgcaagttgctataa

SEQ ID NO: 891 - protein, 640 aa, Artificial Sequence
  Synthetic Peptide
MCTIKCMSQITIQCRFISSESTRHRIWELMAEKNTPLINELLEQVGQHPEFETWRQKGKLPSGIVSKLCQPLKKEERFIGQPSRLYISAIHVVDYIYKSWLALQLRLQRKLEGQTRWLEMLKSDSELIEVTGCSLDAIRTRAAEILAQSASQSDPVTRQQTQDKKKKKFKAKNSNTSLSNTLFEIYRNTEDILTRSYISYLLKNGCKVSDKEEDAEKFAKRRRKVEIRVERLQEQLKSRMPKGRDLTSDHWLETLVIATHNVPKNEDEAKSWQASLLRKSSSVPFPLVYETNTDLTWFKNQKGRICVNFSGLSEHTFEIYCDSRQLHWFKRFLEDQQIKHDSKNQHSSSLFTLRSARLNWQEGEGKGEPWNVHRLTFYCTVDTRLWTNEGTEQVREEKAFEIARTLTRMKEKGDINKNQQAFVKRKHSTLARINNPYPRPSQPLYKGQSHILVGVSLGLDKPATVAVVDATTGEVFTYQSIRQLLGDNYKLLNRERKQQQSKSHQRHKAQKSAAPNSFGESELGQYVDRLLAKAIVAIAQTYQASSIVLPKIGDMREIVQSEIQARAEAKCSVIEGQKKYAKQYRCSVHKWSYGRLIESIQSQAAKTGIAIEEGQQPIRGSPQEQARELAIIAYKSRKLL

SEQ ID NO: 892 - DNA, 2046 bp, Artificial Sequence
  Synthetic Oligonucleotide
atggctgctcaaccagaggaaaataatcaagtccctgagtcgttagattcggattcgcaggaaaaaacgcaggagcaccctcctctcctgctcaacgagatttcaccagaactgcaacgaaagattgatctgattgatgcggtaatgcaggcttccaataagaaggctcgccaggaagcgatcgccagggcagcccaggagctagggctaacagagcgcacaattcggggtctagttcggcgtgtcgaaagcggtgaaggacccgccgtgcttgcagtgggtcgtcaagacaaagggcagtttcgcattgcagaacattggttcaagtttattattgccacctacgaatggggacagaagcaaggttcccgaatgaataagcatcaggttcacaggaagctgggaacattagcaaagttaggtgagaagctgcgagacaagaggtatagaaagctattcatgggtcatcgcaaggcacgtgaagacttagttgcaggcgaatacccatcccatgtcactgtctataaagtcattgatttctacctgaagggaaagcacaagaaggtccgtcaccctggctctccggcagaaggacaaatcattcaaacgaccgaaggaattttggagattacgcacagtaatcagatttggcagtgcgatcacaccaagttagatattctggtagtcgatgagaagggtgacacgatattagaaattgacgacgacggcgaagaggtctggggacgcccttacttgactctgattgcagacagctactccgggtgtgtcgtcggctttcatcttgggctagaacccgcaggctcccatgaagtgggtcttgcgctacgccacgcaatgctgcccaaacagtatggaccggagtacgaacttgaggagaaggagattgtttttgggaaaccagagtactggctaaccgatcgcgcaaaggagttcaaatccaaccatcttcaacaaatctcaatgcaggtcggtttcaaacggcggctacgagcgtttcctcaggcaggtggcttgatcgagacgatctttgacaccctgaataaggaattgttatcgctgttgccaggctacaccgggtctaatgttcaagatcgtcctaaagatgcagaaaaatatgcctgcatcacgcttaaagagcttgagaagcttttagtacggtactttttcaatacttacaactggctggactaccccagagtcgagggtcaaaagcgacatgaacgttggcgttccatgttgctgtcagaaccagaagttttagacgagcggagtctggacgtttgcttgatgaaagtttctcaccgtaaggtcgaaaagtacggcagcgttgagtttgcccgtctgatctatcagggtgactgtttaattccctatcagggtgaggaaatctctctgcgatatgacgagcggaacatcaccgcgctcctagcttacacccgccccgcaggaggacagcccggtcagtacattggcgttgttcgtgcgcgtgatttgaagcaagaccaaatttcgctggaggaactgcgctggtacaaacggaaactgcgtaagcgcggtgtgaaggttgatcatgattcgatcgtcgccgaacgtatgggactgtatgaatttattgatgagaagcggaagtccaagcgacagcgccgcaagcaggcaaaccaggagcatcagcagcaaacgaacgcctccacagtggttgagcttttccctcagaaccagtcggttgagacgcctccagattctcaacccgacgccgaagcctttgtcagcgagtcccaaactgaggacaggacgaaccctcctccaccatcgcagtcagttcctgagccattgcccccggttgacgctccagacagtacagttgcggacctggtgggggctgaagatgcctccgtggtgattgtggacgaggtgtcaacgcctgacgaatcctctgatgactcctctttgtctaatactgtagacttttctcatgagccagtcgttgcttacgattgggaccaacttctagcagataactggtaa

SEQ ID NO: 893 - protein, 681 aa, Artificial Sequence
  Synthetic Peptide
MAAQPEENNQVPESLDSDSQEKTQEHPPLLLNEISPELQRKIDLIDAVMQASNKKARQEAIARAAQELGLTERTIRGLVRRVESGEGPAVLAVGRQDKGQFRIAEHWFKFIIATYEWGQKQGSRMNKHQVHRKLGTLAKLGEKLRDKRYRKLFMGHRKAREDLVAGEYPSHVTVYKVIDFYLKGKHKKVRHPGSPAEGQIIQTTEGILEITHSNQIWQCDHTKLDILVVDEKGDTILEIDDDGEEVWGRPYLTLIADSYSGCVVGFHLGLEPAGSHEVGLALRHAMLPKQYGPEYELEEKEIVFGKPEYWLTDRAKEFKSNHLQQISMQVGFKRRLRAFPQAGGLIETIFDTLNKELLSLLPGYTGSNVQDRPKDAEKYACITLKELEKLLVRYFFNTYNWLDYPRVEGQKRHERWRSMLLSEPEVLDERSLDVCLMKVSHRKVEKYGSVEFARLIYQGDCLIPYQGEEISLRYDERNITALLAYTRPAGGQPGQYIGVVRARDLKQDQISLEELRWYKRKLRKRGVKVDHDSIVAERMGLYEFIDEKRKSKRQRRKQANQEHQQQTNASTVVELFPQNQSVETPPDSQPDAEAFVSESQTEDRTNPPPPSQSVPEPLPPVDAPDSTVADLVGAEDASVVIVDEVSTPDESSDDSSLSNTVDFSHEPVVAYDWDQLLADNW

SEQ ID NO: 894 - DNA, 936 bp, Artificial Sequence
  Synthetic Oligonucleotide
atggctcaacctgctccacaacccaacgcacaatcgcaaccagtccccagccagtccgccactaagccagcgccacaacaatctgtcctggcattgcccaagcgatcgccagaaaaccaggctgaagttgagcgaattcgggacagcgagacttacaaagaggtttctcgtgatcaacttttgtttaagtggttgtcgtcacagcaggaatcgcgtgccagtggctttgtgtacggagtcaattttggagatctgaggaaatcctgccaattttatcaactgctatacgtgcggaaacggggaaacctgtttctcactcccacaccagttctctatgctgaggttgaacagtttggttccccgactgacctttttattggaatcactcaggcaggaggcaatcccttctcaggtatgggatcgttacgagatttgaggaaacaggcggtcggcacacttaaaaaacttcaaaccagcacactgattattggctatgcagaagttttgtcccctgaggcgctcaaagaacttgtaaaaatgaggcgagatctaaaaatctctattattcttgcgggttctatgtgcttatctgagttctttgacaagctcgataagcagcgtggtccaaaacacaaggacattagaaacgcttttctggagtcccaccaatacccctgcttcgagaagaatgagacagaagccattctcgaaggctgggagaatcaagtcttaagctcctggtctaaaaagcttgatctgaagaagattcctggtgttcctaacttcctctacactcgctgtggcggacaggctgaaccgctgtacgagatgctccgcaagatagcgatccaaacgttggacgatccaaagctgcaaattagtacaaccactctcacagagctatttgcagcaaggcgggtagcggtaagcacgtag

SEQ ID NO: 895 - protein, 311 aa, Artificial Sequence
  Synthetic Peptide
MAQPAPQPNAQSQPVPSQSATKPAPQQSVLALPKRSPENQAEVERIRDSETYKEVSRDQLLFKWLSSQQESRASGFVYGVNFGDLRKSCQFYQLLYVRKRGNLFLTPTPVLYAEVEQFGSPTDLFIGITQAGGNPFSGMGSLRDLRKQAVGTLKKLQTSTLIIGYAEVLSPEALKELVKMRRDLKISIILAGSMCLSEFFDKLDKQRGPKHKDIRNAFLESHQYPCFEKNETEAILEGWENQVLSSWSKKLDLKKIPGVPNFLYTRCGGQAEPLYEMLRKIAIQTLDDPKLQISTTTLTELFAARRVAVST

SEQ ID NO: 896 - DNA, 561 bp, Artificial Sequence
  Synthetic Oligonucleotide
atggttgatgagacagacgaagaatttgaactaccacgctggtgtccagaaccttttgaaggcgagagtatcggcagttatctggtgcggtttcgatcgcaagaaattagctccatgtctactatcggtagtttgagtagagcactaaagctgggcacaacgttaggaagatgggaaaagcttcgcttcaatccttctcccagcatggaggaaatagagatcttctgtaactacatagggctggcggtagaaaaactcattccaacctttccggcaaaagggcgaaggacgacgccggaaccgattcgattctgtgcttcctgctacgcagaagccacctatcacagactggagtggcaggataaagcgatcgccaattgtcccaagcatcaagaacctttgctccatcaatgtccaggttgtgaaagaccgttctcgattcctgagctactccagggtgaccaatgtaagtgtggcttgtacttcagacgaatggctgaacaccgagagcggttccaaaggagaaagcttgctaagaggctcaacaggcaaactcattaa

SEQ ID NO: 897 - protein, 186 aa, Artificial Sequence
  Synthetic Peptide
MVDETDEEFELPRWCPEPFEGESIGSYLVRFRSQEISSMSTIGSLSRALKLGTTLGRWEKLRFNPSPSMEEIEIFCNYIGLAVEKLIPTFPAKGRRTTPEPIRFCASCYAEATYHRLEWQDKAIANCPKHQEPLLHQCPGCERPFSIPELLQGDQCKCGLYFRRMAEHRERFQRRKLAKRLNRQTH

SEQ ID NO: 898 - DNA, 2403 bp, Artificial Sequence
  Synthetic Oligonucleotide
atgaggacaattacatttcgactctgcgccagtgaagaaacacgcaagattttctggtacctctgccaagaacatacccttcttgtcaatgctctttctcataaagtacaacagagtaaagagtttcagacttggcaagaaaagggatggcttcctaataagaaattgaaactactgaacaaagaggtactcgaagaaaagacagcctttcaagtccaagtactagaccaaacaaagttgccagacctaccttccagattcattgcctctgcaattcgggctaaccagcagacgtggggatcttggattgcacagcaaaggaggcgttatatgagcctgactggtaaacaggactggttgcagttgcaggaatgcgatcttgatttgtcacagacgaccgattttacgtttgctcaaatttgtactgaagtgcgagaggtgctggcaagcgtcacagcacaaatcgcggcagaggaacagaagaagcaaaaccagaagaagcgatcgcgtcaaacaacgaaggcaaagcgtacggtcaaaaagcagaaaaaagtatctgaatcccgccgcattacagaggctctcttcaaattgcttaaaaagaagcagaacgcgctaactatgcgtgcaatagcgtatttgttgcggaacaatgcaactgtgcaggaggacgaagagaatcctcaagaaattgcactgaaactagaccagaagcggatcgagattgagcgactcaaaactcagttgcaaagtcaatttcctaaaccgcgtgatcctacgggtgcaattgcggatcgttacattaatgaagcactggagaagccaagttttgctacttcctggaaaatcttggtactgttctgtctgctgataactaaccaggagcttcctggactcagtctgcaatttcacagtcatctacttcaacaactgcaacatcccgatttatcaagagaagcacagcaagctgagttcaagtcttgggaagagggctgcttggagcggatgactaaactggcgaccgttctcaagtcattacctctacccatcagctttgatagcagtgacgatctctactggtcagttgagccaaagcagcagaaagctgttgaacccaaggagacaacacctgcgcctactgacggtcaaccccggcgatcgccaaaacgaaaacgcaaaaatcgccgcaagattcaggttcaagagcggatcgtggtacgttttaaggggctaagagaacacaagtttggtgtgcagtgcagccatcgtgatctcgcaattcttcagcagtgccagcgtgagtgggaaagatatgggtcattgccggacgacaagaagtttagtttaggactcttcccggcacgagcggcacgtctcctctggcgtaaggataagcagcagcgtaaaccctctgctaactcacctggtgagaagtcacaggttgaagaatggcgacagtaccggctctacctgcacatcacgatcgatgataggttactctctgctgagggaaccgaggaagtgcggcaggagaagctcattaaagcgcaggatgaccagaaaacgatgcgaaagcgcaagtcacctcgcaagaagcttgaggaagcggagttaacccaggaacagaaagagaagaaggctaaggatggtgccattgccaaaaaacgagtagcttcaacgcaagctcgtttaagcgatcctaccagattaaagcgtcccagtcgaaagccctatcaggggcagtctcatattcaggtacgggtatgttttaaccagcaggagcgtgtcagtcttgctgtgttcgatactcagcagcagcaggtcttagagtatgtgagcgtgcgagatttgctgtacgaccacagtgccgagaaacatcatcagcacttcatcagtaacccaaagcgtaaaggtaagcgcacgcttgagcaaatgcaactggagcagtaccacctgctcgatcgcttaaggaaacagcaggtcaaaaatcaccaacggcggatgcgggcacaaaagcagggttactacaaatacagcaaatcagaatcgaatttgggcgagtacctagatcgtcttttagctgcccgtattggtcaactcgctgttcagtggcaagctagctcagtcgtcattccagatttagggaatctccgcgagagcgttgaggcaaagttgcaagcctgggcagatctaatttttcccaaaatggaggaagttcaacaaaagacaaccaaaaaaattcgcgtcagttttcatggctggagctatggtcgattagcacgctgtattcgcagtcgagccgctcgtgacgggttggcgatcgtgatcggtcagcagccacaacagggaagtttgcaagaaaaagcaagagcagtagcacctgccaattcgacaacagcctga

SEQ ID NO: 899 - protein, 800 aa, Artificial Sequence
  Synthetic Peptide
MRTITFRLCASEETRKIFWYLCQEHTLLVNALSHKVQQSKEFQTWQEKGWLPNKKLKLLNKEVLEEKTAFQVQVLDQTKLPDLPSRFIASAIRANQQTWGSWIAQQRRRYMSLTGKQDWLQLQECDLDLSQTTDFTFAQICTEVREVLASVTAQIAAEEQKKQNQKKRSRQTTKAKRTVKKQKKVSESRRITEALFKLLKKKQNALTMRAIAYLLRNNATVQEDEENPQEIALKLDQKRIEIERLKTQLQSQFPKPRDPTGAIADRYINEALEKPSFATSWKILVLFCLLITNQELPGLSLQFHSHLLQQLQHPDLSREAQQAEFKSWEEGCLERMTKLATVLKSLPLPISFDSSDDLYWSVEPKQQKAVEPKETTPAPTDGQPRRSPKRKRKNRRKIQVQERIVVRFKGLREHKFGVQCSHRDLAILQQCQREWERYGSLPDDKKFSLGLFPARAARLLWRKDKQQRKPSANSPGEKSQVEEWRQYRLYLHITIDDRLLSAEGTEEVRQEKLIKAQDDQKTMRKRKSPRKKLEEAELTQEQKEKKAKDGAIAKKRVASTQARLSDPTRLKRPSRKPYQGQSHIQVRVCFNQQERVSLAVFDTQQQQVLEYVSVRDLLYDHSAEKHHQHFISNPKRKGKRTLEQMQLEQYHLLDRLRKQQVKNHQRRMRAQKQGYYKYSKSESNLGEYLDRLLAARIGQLAVQWQASSVVIPDLGNLRESVEAKLQAWADLIFPKMEEVQQKTTKKIRVSFHGWSYGRLARCIRSRAARDGLAIVIGQQPQQGSLQEKARAVAPANSTTA

SEQ ID NO: 900 - DNA, 2046 bp, Artificial Sequence
  Synthetic Oligonucleotide
atgatgtctaccgaagacgatcgcgaacagtcagaagtcgttgatgagccttcagaaacactagcacttgatgccagcaactttgttgcggattgtaaacaaaccctgcttgagaatctagataaacatacatcaaggtttgctttagctcagtgggtagctaattctcccaatcgcgatatttttcttcaaaggaagcaagagatcgccgacacattggagctttccatgcggcaggtggaacgaattttaaagagttatcacaaaagtgaattaaaggaaacctctggaactgagagatcagataagggtgagtacaaaatcttgccttactgggttgactacattagatggttctacgatgacaggattgagaaaaggttgtctatatctcgtgctgatgttgtcagagaagtagaacgacacgcagaaattgacctacaacttcagccaggtgaatacccgcatcgtgcttcggtttatcgtgttttagcccctgttgtagcacgtgcggctttacaaaagaaaattaggaaccccggttcaggttcatggttttatctaaaaacccgtgatggcgaattcatcaaaattttctgtagcaaccaggttattcagtgtgatcacacaaaactagatatccttattgttgacaaagatggcaaagtcttgggtcgtccttggctgacaattgtagtggatagcttctctagctgcgttttagggtttttccttggactcaaacaacccggcaccgaagaggtagcgcttgctctacgtcatgcagctttacctaaacattaccccgacgactatgaactgctaagaccttgggatgtcaatgggctaccgctccagtactttttcacagatggtggaaaagacttgtcgaaagcaaagcacattcaacagatcggcaggaatttcaactttaagtgcgagttacgctttaaccctcctcaaggtggcattgtagaacgcgtttttaagaccattaatagtaaagtgcttcaggggcttccaggctacacgggttcctgtgttgaagatcgcccaaaacacgccgaagaaaccgcctgtctaacctggagggatgttaagaaaatcttgaccgggttcttctgcgatagctataaccacgacaaacatcctaagaaaaagggtatgacaaggtatgaatactggttagagggattggggggaaccttaccagaacctattgatgagcaagaattagatctttgcttgatgaaagcagcataccgctctgttcaagcccacggttcagtaaattttgaaaatgttacctacaggagcgaagagcttaaaaatcacttgggggagcgagtaacgctgagatatgatcccgaccatattctaagccttcgagcttatacctatgaagcggatgaaaaaatgggagagttaattgacgataatgtgaaagctctcaatctagaatatcaggctctgactttggatgaattgaagcaaattaatgcaaagttgactgaggaaggtaaagaaatcgataactatacgattcttcaggaactggggcgtagaaccgaaatggttgatgaggcaattcagaaccgaaacgatcgcagaagagcagcacacaaagaggctcgaagtgagcataaagataactcaaccaaacctggcagtcgtaagacaactaagaaagcttcagtcaccctccgtggaagcgtacctcccagcttggctgaagcagaattaacagccccaagtgcacctgaagccgaagagagtgacatttccgctagcacgctagagcttttacagcttcctgataagcctgacgggacggttttctatcctctttccgacgatggcagtgccgaaatcgttcagacagaaatcgctcaagcgtcagttgtcgagcagagtttggcagcgatcgtgactcctctagctgaaaaagctactacggaagcagtcattacgcctcaagtcgaatccccaaaacagaaggagtgctacgatttcattatttcaaaacgttcgcgccgaagtcgatag

SEQ ID NO: 901 - protein, 681 aa, Artificial Sequence
  Synthetic Peptide
MMSTEDDREQSEVVDEPSETLALDASNFVADCKQTLLENLDKHTSRFALAQWVANSPNRDIFLQRKQEIADTLELSMRQVERILKSYHKSELKETSGTERSDKGEYKILPYWVDYIRWFYDDRIEKRLSISRADVVREVERHAEIDLQLQPGEYPHRASVYRVLAPVVARAALQKKIRNPGSGSWFYLKTRDGEFIKIFCSNQVIQCDHTKLDILIVDKDGKVLGRPWLTIVVDSFSSCVLGFFLGLKQPGTEEVALALRHAALPKHYPDDYELLRPWDVNGLPLQYFFTDGGKDLSKAKHIQQIGRNFNFKCELRFNPPQGGIVERVFKTINSKVLQGLPGYTGSCVEDRPKHAEETACLTWRDVKKILTGFFCDSYNHDKHPKKKGMTRYEYWLEGLGGTLPEPIDEQELDLCLMKAAYRSVQAHGSVNFENVTYRSEELKNHLGERVTLRYDPDHILSLRAYTYEADEKMGELIDDNVKALNLEYQALTLDELKQINAKLTEEGKEIDNYTILQELGRRTEMVDEAIQNRNDRRRAAHKEARSEHKDNSTKPGSRKTTKKASVTLRGSVPPSLAEAELTAPSAPEAEESDISASTLELLQLPDKPDGTVFYPLSDDGSAEIVQTEIAQASVVEQSLAAIVTPLAEKATTEAVITPQVESPKQKECYDFIISKRSRRSR

SEQ ID NO: 902 - DNA, 885 bp, Artificial Sequence
  Synthetic Oligonucleotide
atgttagagtccaacttggtttcacagcctatcgtagagatcttagcttcgttggcagacacgagagttaaggtgtccgccttggaaagactactcaacaatggctatataccaacagatgctgctgagtctgcgatcaattggatggacgagcggcggtttttgaaacaatgcggtcggcttgttgctccacgtggaagtggtaaaagtcggctgtgtgaggaatatgaagatcgagattttgaccgcgttattcgggtaaaggctcctacgggatgttcttctaagcaagttcatagattaatccttaaagcaatgaaccatgcggcaaagatcaggcggcgtgatgatccaagagcaatggtagtcgagagtgtgatgccgttcgaaattgaggtaatccttattgataacgcgcaaaatttggcagtagaagcattctctgatcttaaagatctttacgatgagaaaaaggtaactatcattttctccggcacacctgatttagatgtttcgctggagcaagttgggctgttggaaagtttcccttactcttatcctctaggttctttgtccgaagctgattttaagaaagttttggacacgatcgaagcaaaagcactgaatcttccctttgaatcgaagttaagtgagggagagaaatttgagctcttaacgacatgcacaggtagtttgattggaaggctgatgaagcttctaccgacagcaattttatattctgttcaaaaagtttcagagcaggaggcggatcaaactgagtcacagcctatgtataagctggatagcatatctcttgaagcgcttagaaagattgcagtagggtacggggtaaaagttccgtttggaaaatctagttcaaagtaa

SEQ ID NO: 903 - protein, 294 aa, Artificial Sequence
  Synthetic Peptide
MLESNLVSQPIVEILASLADTRVKVSALERLLNNGYIPTDAAESAINWMDERRFLKQCGRLVAPRGSGKSRLCEEYEDRDFDRVIRVKAPTGCSSKQVHRLILKAMNHAAKIRRRDDPRAMVVESVMPFEIEVILIDNAQNLAVEAFSDLKDLYDEKKVTIIFSGTPDLDVSLEQVGLLESFPYSYPLGSLSEADFKKVLDTIEAKALNLPFESKLSEGEKFELLTTCTGSLIGRLMKLLPTAILYSVQKVSEQEADQTESQPMYKLDSISLEALRKIAVGYGVKVPFGKSSSK

SEQ ID NO: 904 - DNA, 534 bp, Artificial Sequence
  Synthetic Oligonucleotide
atgaccagcaagcttagtaaataccccagattgccaccccttgagccttactcaggcgaaagcctaccacattatcttggtagatttcgacgcctaaaaagcaccggagcaccctctccaagtgcgttgggacaaatggtggggattggtgcggttgtggctcaatgggaacaggggtatttcaacccttttccaacagttgagcagctttctactttagggacagtcatcggtttagacatggatacattaacccggatgctgcaaccaaaaggggtaacgttagattcaagaccaattcgtttatgtggagcttgttacgccgagcacccttgtcaccggattaagtggcagttcaaatccaaattgagtccaaggtgcgatcaccacaagctcaaactattaatgaaatgcccaggctgtgagcagccatttccagttccttcgctttggctagaaggaaaatgccaaaacgcaaaatgcggcatgcgatactcaagaatggcgaagcatcagaagtccgtgctttattaa

SEQ ID NO: 905 - protein, 177 aa, Artificial Sequence
  Synthetic Peptide
MTSKLSKYPRLPPLEPYSGESLPHYLGRFRRLKSTGAPSPSALGQMVGIGAVVAQWEQGYFNPFPTVEQLSTLGTVIGLDMDTLTRMLQPKGVTLDSRPIRLCGACYAEHPCHRIKWQFKSKLSPRCDHHKLKLLMKCPGCEQPFPVPSLWLEGKCQNAKCGMRYSRMAKHQKSVLY

SEQ ID NO: 906 - DNA, 2478 bp, Artificial Sequence
  Synthetic Oligonucleotide
atgcagatgcggactattaaaactgactccatagtcagaatcacccagcgtcgtaaaaggaagggagtcacagaggacctgccctcgtttgatgaagcagcctggtgccgtttatgtgaatttagctataaacatacgctgctggtcgatacgatcgttagccagatcaaacagcatcataagctcatcaattggatacgtagcagtcaagagcttcaaagacaggatgacaccactcaggaaacagaagcgaagcaggggcaaaatgggttgccagaggggttagtcaaagcattgtgtgatgctctagcaagcacgcctcagtttagtaagatgtctggacgcttctatacctcagctatcgatcgcgttgaagaactcttcaaaggctggtttgctgctcaccaaaaattgatccataaaataaggggaaaacgacgctggttggcagttgttgaaagtgatgctgctttagctgagaccagtaattttagccagcaggaaatcgagataagagctgcgcaaatcctagccgaactagaagctcacaatggaacgaatgctggcagcaatgatcatgtagatttcaacaccctattccagaaatttgacgagacagaagagactctagctcgccgtgccattattcatctgctcaaaaatggaggtaagacccacgcggaagtaaagaagcctagaaagagaaagagaaagggcaaaagcatctctacacagcctctaacgcttactgagcgtttggaagcgcagcgagttggaatagaacgtttggaaaagcagcttctaggacagcttccgagagccagaaatctctttcctgaacaggcatttgagcaccatctggaagcggtaattgccatgccgaactcagatgcaaccgagcttgagcggtattactttttgtatttctcactgttgctttatcttgccgatgccaacgagtatcttcaacttgagcggcacttactgacaacactggtacttcaatggagcaaattaggtgatctccattactatcgagttttgatttatgcttttatgctgcacgctgcctctgcacagcaatatcttcaacttgggtcttatttactgcaaaccatcaaacttgaggcagaaagagttgaagctgctttctttgcttggcatgagtcaatcacaccaaagttacacgacttcttgagagagcccaaagctctaccctaccccattagttttggctacgatgatgtccgatcgtggcaaatgaatcaaaaagggaaaattttcttcaagttaaatggttggggtgacttgctctttgaggtacgttgccaccatcgtcagttgccgctgatcaaaacctttctgaaggactggcaaactaaaaacgcctctgaaaggaaagctcaatcttcaaagaaggatccatttacagggagcttgatgctgctccgttccattgaactgatctggaagcctaaagaagccagcgatcaaaaagatgcccagttgtgctcccactgcgaggtgtttcagcagtccagcgaacaagggttctggaatgaatgcaagctcacgattcattggacttttaatgccgaggctctgacacgtcagggttcagaaaagatgcgtcagcgcaagctggagctacagttgcagcagttgcaggcgaaacaggcaaagctggaacagcagcaagaccggctggacaagttggagcaagcagcaccagaagctgccaagagccaagagcaactcaaacgcattaggaatctgaaaaagcagattcagcagcttcaggaagatcttgccaaactacgcccaaaactagcttgtctccaagctgcccaaccgtttgggcgtcccgatcgccccctttacgaaggtgtccccaacatctttgttggtgtgctccttgatctcgacacacatcttgccgtgaccgtcgtggatgcgatgcgccgtaagcgtttagccctccgcagcgctcctaagatttcatcagaaggttacaggctcctccaaaaatattttcggcaacgacaggaacactcaaaacaacgccaagaagatcagcaagcacagcggtatagccatcagactgaatctggcttaggtcaacaggtagaccgtttgtttgccaaagggttagttgaattagcacaggcgtacaaagctagcacgatcgtcatcccgatcaagggtggatggcgggagcgattatatagccagctagttgccagagccaaacttaagtgcaatggcaacaaacaagcgatggctcgatacaccaaagcacatggcgaacggctgcatcagtgggattacaaccgtttaagccaagcaatcacggattgtgccgccacgcatggtatagaagttgttttacaaaaaactgtgtttgaaacagatgtgtttcaacaggcagcaaaccttgcaatcgcagcttacgattcgttaaattctgctcaaacgtga

SEQ ID NO: 907 - protein, 825 aa, Artificial Sequence
  Synthetic Peptide
MQMRTIKTDSIVRITQRRKRKGVTEDLPSFDEAAWCRLCEFSYKHTLLVDTIVSQIKQHHKLINWIRSSQELQRQDDTTQETEAKQGQNGLPEGLVKALCDALASTPQFSKMSGRFYTSAIDRVEELFKGWFAAHQKLIHKIRGKRRWLAVVESDAALAETSNFSQQEIEIRAAQILAELEAHNGTNAGSNDHVDFNTLFQKFDETEETLARRAIIHLLKNGGKTHAEVKKPRKRKRKGKSISTQPLTLTERLEAQRVGIERLEKQLLGQLPRARNLFPEQAFEHHLEAVIAMPNSDATELERYYFLYFSLLLYLADANEYLQLERHLLTTLVLQWSKLGDLHYYRVLIYAFMLHAASAQQYLQLGSYLLQTIKLEAERVEAAFFAWHESITPKLHDFLREPKALPYPISFGYDDVRSWQMNQKGKIFFKLNGWGDLLFEVRCHHRQLPLIKTFLKDWQTKNASERKAQSSKKDPFTGSLMLLRSIELIWKPKEASDQKDAQLCSHCEVFQQSSEQGFWNECKLTIHWTFNAEALTRQGSEKMRQRKLELQLQQLQAKQAKLEQQQDRLDKLEQAAPEAAKSQEQLKRIRNLKKQIQQLQEDLAKLRPKLACLQAAQPFGRPDRPLYEGVPNIFVGVLLDLDTHLAVTVVDAMRRKRLALRSAPKISSEGYRLLQKYFRQRQEHSKQRQEDQQAQRYSHQTESGLGQQVDRLFAKGLVELAQAYKASTIVIPIKGGWRERLYSQLVARAKLKCNGNKQAMARYTKAHGERLHQWDYNRLSQAITDCAATHGIEVVLQKTVFETDVFQQAANLAIAAYDSLNSAQT

SEQ ID NO: 908 - DNA, 6665 bp, Artificial Sequence
  Synthetic Oligonucleotide
taacaaaatattgtcacaaaaaataaaaattattgaaaccctgctataacaaggatcatagcagggtttagttattataccttctaatcattttgtgaaaccttttttaacaaattaattgtcaaaaaagggaaaattaacaatttaagtgtcaattcccaaaatccatgtaaactactctacttctgaaaatttcacacattaaatgtcacttttgatttataatatacaaatatgttccaattaaacatcaatgtatatgaggaatgaaacacctataactccagacaacttagaaactgaaagtgttaccgccaaagatactcaaatcattgtgtcggaactttccgacgaggcgaaactaaaaatggagattattcaaagtttattagaagcaggcgatcgcactacctatgctcaaagactcaaagaagcagcagtaaaactgggtaaatcagtacgaacagtaaggcgactgattgataaatgggaacaggaaggcttagttggtctgacgcaaactgaccgggttgataagggtaagcaccgagttgatgaaaactggcaggagtttattctcaagacttataaggaaggtaataagggcggcaaacgcatgactcgccaacaagtagcaatcagagtgaaggtaagagcggatcaactaggtgtcaagcctccctctcacatgactgtttaccgtattcttgaacctgtgattgaaaagcaagaaaaagcaaaaagcatccgcactcctggttggcgtggttctcgattatcactgaaaactcgtgacggactagatttatctgtcgaatacagcaatcatatctggcaatgtgatcatactcgtgctgatattttactggtggatcaacatggtgaacttttagctcgtccttggctgacaacggtgatagatacttattctcgttgcatcatcggaattaatttaggttttgatgcacctagttctcaggtggtggctttggcactgcgtcacgccatattacccaaaaaatatggagcagaatatggactacatgaggaatggggaacttatggcaaaccagaacacttttttactgatggtggtaaggattttcgttctaaccatttacaacaaataggtgtgcagttaggctttgcttgccatcttcgagattgccccagtgaaggcggtattgtcgaacgtccctttggtactttgaacactgatttattttctaccttaccaggatacacaggctcaaatgtgcaggaacgtccagaggaagcggaaaaagaagcttgtttaactttacgagaattagaacgtctattggtaaggtatctcgtagacaaatataaccaaagtattgatgctcgtttgggtgatcaaactcgctatcaaagatgggaagctgggttaattgttgcccccaatttaatctctgaggaggatttgcgtatttgtttgatgaagcaaactcgacgctcgatttacaggggtggatatttgcaatttgaaaatctcacctatcggggtgaaaacctagctggttatgctggggaaagcgtggtgttgcgatttgacccgaaagacattacaactatcttggtttatcgccaaacaggttttcaagaggaatttttagctcgtgcctatgcccaagatttggagactgaagaattatctctggatgaggctaaagctatgagtcgtagaattcgccaagcaggtaaagaaattagtaatcgttcgattttggctgaggtaagagacagagaaacttttgttaagcaaaagaaaacgaagaaggaacgccaaaaagaagaacaggttgtggtggaaaaagccagcagtgagcgaagtcgaactgctaaaaaacctgtgattgttgaacctgaagaaatagaagtggcatctgtggaaagttcctcagatacagatatgccagaggtttttgattatgaacaaatgcgcgaagattacgggtggtaaattatgatttcacaacaagctcaaggtgttgctcaagaattaggtgatattctccccaatgatgagaagttacaagcggaaattcaccgattgaatcggaagagttttattcctttggaacaggtgaaaatgctccatgattggttagatggtaagcgacaatcacggcagtctgggagggtgctaggagagtcaagaacgggtaaaactatgggttgtgatgcctacagactcaggcataaaccgaaacaagaaccaggaaaaccgccaactgtgcctgttgcttatatccaaatacctcaagagtgtagtgctaaggagttatttgccgcaattattgagcatttgaagtatcaaatgacaaagggaacggtggcagagattagagatagaacgctgcgggttctcaaaggttgtggggtggaaatgctgattattgatgaggctgatcgttttaaacctaagacttttgcggaggtgcgggatatttttgataagttggaaattgcggtgattttggtgggtactgatagattagatgctgtaatcaaacgagatgagcaggtttataaccgttttcgcgcctgtcatcggtttggtaagttttctggggaagattttaagcgcactgtggagatttgggaaaggcaagttttaaaactgcctgttgcttctaatctttccggtaaggctatgctgaagactttgggtgaggcaactgggggttatattgggttgctggatatgattcttagggagtcggctattcgggctttaaagaagggattatcaaagattgatttggaaactttgaaggaagtaacggcggagtataagtaatggaagttggggaaattaatccttggttgtttcaggtagaaccttttgagggggaaagtatcagtcattttttggggcggtttcgacgggcaaatgatttaacaactactggtttgggtaaggctgctggggttgggggtgcaatatccagatgggaaaagtttcgttttaatcctcctccttctcggcagcaattggaggctttggctaaggttgtgggtgttgatgctgataggttagcgcggatgttacctcctgctggggtgggtatgaatcttgagccgattcggctttgtgctgcttgttatgtggagtcgccttgtcatcggattgagtggcagtttaaggtgactcaggggtgtgaggatcatcatttaagtttgttgtctgagtgtcctaattgtggggctaggtttaaagttccggcgttgtgggttgatggttggtgtcttcggtgttttacgctgtttggggagatggtaaagagtcagaattttattgaatcacataacaaaatttaaacataaatcttcaaaattcctattcgataatactttcagccattctttgattttataaatgcctaaatttttattttcagtcacataaccgtcacataagattaatttatttattccatagatataaataatcatttatgcccaaaatggcacatatttagcgtgtttcttagatttattttcaggatcatagggcttaattaagttttcattaattgtatccgcaataattcgggaagccatagaatagttttacatcaaaacttatccccgtagacagccaatataccaaagcagccagttccaccagattagacctggagtaataaatactgcgtcccgttcccgtctcactaatcacaggcacaacaatccctttctctcgccaatactggatctggcggagagtacaacctgtaatttgagccgcttccttacttgtgaaaaatgtttcttgcataaaaaactattttacagaaagaagctatagtacaaatatggtagtattaaacaaatatgtttattatatgagccaaatcactattcagtgccgtctactggcgagtgaatctacccgtcaacagttatggcaattgatggctgagaaaaacacgccactgattaacgaattactcatgcaaatgggtaaacatccagaatttgaaacttggcgacaaaaaggtaaacaccccacaggtgtagtcaaagaactgtgtgaacctttgaaaactgatccgcgcttcatgggacaacctgcaaggttttacaccagtgccacagcatcagtgaactatatttataaatcctggtttgccttaatgaagcggtttcagtcccaactagacggcaaactgcgctggttagaaatgctcaatagtgatactgaattagaagcagccagtggagtctccttggatgtacttcagactaaatctgccgaaattttggctcaatttgctgcccaaaatcctgctgaaactcaaccagcaaaaggtaaaaaagggaaaaaatctccaacttcagatagcgaacgtaatttatcaaaaaacttatttgatgcttacagtaatacagaagataatttaactcgttgtgccattagttatttactcaaaaatggctgtaagattagcaataaagcagaaaataccgataaattcgctcaacgtcgccgcaaagtagaaattcaaattcaacgtttgacagaaaaattagctgctcgaatccctaaaggacgagatttaactgataccctaagattggaaactctttttaatgctactcagactgttcctgaaaatgaaaccgaggcgaaattatggcaaaatattctgttaagaaaatctagtcaagtgccgtttccagtggcttacgaaaccaacgaagatttagtttggtttaaaaatcaatttgggcggatatgtgtaaaattcagtggcttgagtgagcatacttttcaaatttattgtgattctcgccaacttcactggtttcaaagattcctagaagatcaacaaattaagaaagatagtaagaatcaacattctagtgctttatttaccctgcgaagtggtcgtatttcttggcaggaaggacaaggcaagggagaaccctggaatattcaccatttaactctttattgttctgtagatactcgtttgtggacagaagaaggaacaaatttagtcaaagaagaaaaagccgaagaaattgctaaaaccatcacccagacaaaaaccaaaggtgatcttaatgataaacaacaggcacatctcaaacgtaaaagttcttctttagctagaattaataaccatttccctcgtcctagccaacctttatataagggactatctcatattctagttggtgtgagtttaggtttagaaaaccctgccacaattgcagttgtagatggtacaacgggaaaagttttgacatatcgcaacattaaacaactacttggtgaaagttataaattactcaatagacagcgacaacaaaaacacctgttatcccacgaacgccatgtcgctcaaaggatgtcagcaccaaatcaatttggagattcagagttaggggaatatatagatagattacttgcaaaagaaattattgcagttgcccaaacatataaagctggcagtattgttattccaaaattgggagatatgcgagagcaaattcagagtgaaattcaatctaaagctgaacaaaaatcagatataatagaggttcaacaaaagtatgccaagcaatatcgaactactgttcatcagtggagctacggtagattaatctctaatattcaaagtcaggcaagtaaagcaggaatcgctatagaggagggaaaacaaccaattcgagcgagtccattagagaaagccaaagaattagcgataagcgcctatcaatcccgaaaagcctgattgacaaaataccgaaccttaataatagaataggaattaacaatagcgccgcagttcatgtttttgataaacctctgttcggtgacaaatgcgggttaggttgactgttgtgagacagttgtgctttctgaccctggtagctgcctaccttgatgctgctgttccttgtgaacaggaataaggtgcgcccccagtaatagaggtgcgggtttaccgcagtggtggctaccgaatcacctccgagcaaggaggaatccaccttaattatttatttttggcgaaccataagcgaggtcaaaaaccctggggttctgccaaaggtctaaatccgttgtctagtctgtgtttcagatgttaagatgctttgataatgttctcttcagagggaaattaggagcaaatttaggacatctgccaaaattgcttttggaggtgtctttagataagggtttggtcgggcggagttttaacacccctcccggagtggggcgggttgaaagacacagatggaagatcaccacggcacaggatttataggtttcaacacccctcccggattggggcgggttgaaagacatttatgcaagtataataaaaaatatctgggtgggttgaaagatcagtaggtcgtgggtttaactctgaaaacactatataaatacagtgttgcttgtgatagttagggacaattaatttgttaacagtgacacgaattagttaaaatgacattaatctgttaacagtgacaaataaattgttaatgtacacgaacgtacaacctaaagccgatgatgagatttgaactcacgacctactgattacgaatcagttgctctacccctgagccacatcggcgcatacagtctagtataataacataatttactaatgatg

SEQ ID NO: 909 - protein, 576 aa, Artificial Sequence
  Synthetic Peptide
MYMRNETPITPDNLETESVTAKDTQIIVSELSDEAKLKMEIIQSLLEAGDRTTYAQRLKEAAVKLGKSVRTVRRLIDKWEQEGLVGLTQTDRVDKGKHRVDENWQEFILKTYKEGNKGGKRMTRQQVAIRVKVRADQLGVKPPSHMTVYRILEPVIEKQEKAKSIRTPGWRGSRLSLKTRDGLDLSVEYSNHIWQCDHTRADILLVDQHGELLARPWLTTVIDTYSRCIIGINLGFDAPSSQVVALALRHAILPKKYGAEYGLHEEWGTYGKPEHFFTDGGKDFRSNHLQQIGVQLGFACHLRDCPSEGGIVERPFGTLNTDLFSTLPGYTGSNVQERPEEAEKEACLTLRELERLLVRYLVDKYNQSIDARLGDQTRYQRWEAGLIVAPNLISEEDLRICLMKQTRRSIYRGGYLQFENLTYRGENLAGYAGESVVLRFDPKDITTILVYRQTGFQEEFLARAYAQDLETEELSLDEAKAMSRRIRQAGKEISNRSILAEVRDRETFVKQKKTKKERQKEEQVVVEKASSERSRTAKKPVIVEPEEIEVASVESSSDTDMPEVFDYEQMREDYGW

SEQ ID NO: 910 - protein, 278 aa, Artificial Sequence
  Synthetic Peptide
MISQQAQGVAQELGDILPNDEKLQAEIHRLNRKSFIPLEQVKMLHDWLDGKRQSRQSGRVLGESRTGKTMGCDAYRLRHKPKQEPGKPPTVPVAYIQIPQECSAKELFAAIIEHLKYQMTKGTVAEIRDRTLRVLKGCGVEMLIIDEADRFKPKTFAEVRDIFDKLEIAVILVGTDRLDAVIKRDEQVYNRFRACHRFGKFSGEDFKRTVEIWERQVLKLPVASNLSGKAMLKTLGEATGGYIGLLDMILRESAIRALKKGLSKIDLETLKEVTAEYK

SEQ ID NO: 911 - protein, 173 aa, Artificial Sequence
  Synthetic Peptide
MEVGEINPWLFQVEPFEGESISHFLGRFRRANDLTTTGLGKAAGVGGAISRWEKFRFNPPPSRQQLEALAKVVGVDADRLARMLPPAGVGMNLEPIRLCAACYVESPCHRIEWQFKVTQGCEDHHLSLLSECPNCGARFKVPALWVDGWCLRCFTLFGEMVKSQNFIESHNKI

SEQ ID NO: 912 - protein, 173 aa, Artificial Sequence; identical to SEQ ID NO: 911
  Synthetic Peptide

SEQ ID NO: 913 - DNA, 7720 bp, Artificial Sequence
  Synthetic Oligonucleotide
tggctctgggctcccctgcccaagctaatgtcatagtggaggcctcaggccctgcaccaacatggttccgtagtccctggagtcaggctgggggagcccagggctgaggctccctttcatcccctcccaccaggaaagggtctttctcggtatttcccacaaacactcatatcaccacttgacagccttttcattccattctcccgcctctctcagccccaccacacccctgacacattccttcccccacttcagctcctggatcgcaggcaggggcaccctgcctatcccctctcccaaagcgggtgcctgggagctgacatcttggctcaccttctcctcctttgtcttctcttcctttcccccactccccagcatttcatccaagccagaaatgggcctagaagtctgtagaaagacatcccgctgctatcactccacaaatcctctagagaagatgagtttggtagacctctgcttatctgatttaaattcttcttgctgtaatctcagctgttctggttggtggcaatgggcaaactcaggatgttggtcagacaatggactgaagagtttacttttctctgcttccctgcccaactgtacttgagtaatctttatagtatctctaaaagatggtcctggaatggtgctccctggtccttccctgtctcttgcagtcggccaggacacaggcgggagtatccacagctctcattttacagcttccttcccgttccctacagcaatagagggggagccctaacggggttttagcaatcagtccagccccttcagtctggaaaggaggacactgaggcagggatgggcggtgccttgctccaggccacacaacaaggcagtgacagtggctgcgtttgaacccaggtgtcctaacctccaggacccacacatggcaatctgaggaactgctcggggagcagagtgcttaatgacagggcttcagggacactatttgtcagaggggctttcaaggtaactcctgtggtggtgttgggagggggtgctcagccgatgcctagtctctctgtagccttggtggggaggccactgtgacccaggtcagcttgcctggaacagctgggtttctggaaacacttctctcttctctatggggccctgtcgtgggtggtggtggtagacggggtttgtttgtgtgtgtgtatgtgtggtttagtagtccctgcagccttcagcctggaaagctgaggaggcatggagaggcagggggttggtggatgagtgacgggagggaaatgcagtgggggaggagatgccaccgcagggctacggtcagagttggtgaagggcagattcaccgtgcctccctctgtcctccttaagacctctggtcatgccagggtcttatggagggggcttggtgctccgcactgtatttgttgctctctctggagttgctgtaccaactctcctggcatcccgacaggcaggagtatgtcccatagccacagaaatgccctttttgcaggttcttcctagttcttggagggctagaaggaactgaggggatgtgaagagcatctttcctcctagcttgttccccactgcccaggcttgctccccgacagtgaatgggaagtggggagcagtcaccttcccagggggctccagaaagctgaggacagagtagctaagctcacagaggagcacttagtcaatgggactgacccaggagggccccgggacaatggggctaggcagaaaggagcaagaaagaaggaggcaaggagggatggagacatctgaggaaagacagagaaggaagggaaaaggaaatgctctgttcacccataactgtccatgatctggacacttggggttggaattccaccccagagctggggcttgccttgtctaccatgttttcaacagtgtctaggtcccatgagtccaccgcctcaggcctggcctctggaattgaaggcctggtgaggtacctgctatgttgggtgtgggctacacttatgcatgaagattagtggggagtcctggcctggcctttccaagagaggaggaggtagggaggcgtgcagaccagggacccagacaggcctcattctcagcagggagctgcacattccagcctagagtcaagagcggactggggcagggcagacattcacctggtgtaccccagcacgcctcctgattgattggtaaatagctgttgttccagtccttgagttccccctgtgcctctctggccaccccagtcccttacttggtcccctggacctctccaccatccagaaattgaggtttatgtctggcttggcatacgccgtcagctctatgtgaactgtgcctgagccatagcaggtgttaaatgttttggccatcatcctgagctccgcaggggccttgtgccccacagctggagctgactgcgaccaggtcctggaacttggagaagctggcagcaggcacagcagctctgagcatgccctgcctcacttctcctgatgcttccagctgtgttctggaaggagatgggtctggataagcaggctggcatgcagggagatgtaggcgggaccatctctccaggagaccccagtagggaatggtttagctgtggcctctgcagggcactgcctggagtaagggagtgctgagcccctctagggaaggaggagcaaacaacagatccctgggtcagctgctgacacactcctatgcacgcggcatctagttctagcacctcctctctggcactgcctggctccccacccagccagtcagctcttagaggcagaagcccagtgtatcccaaaggtgcctggctcagtgctgggccccgattaaatgatgaagtggcctggggaggtagaaagagccccaggctgtgagttgagtgatctgggttgaggtcttgactctatgcagcgctccggctttggacaactctgggcttccttctgctcctctggccagtaagcttctttagcagtggaaacttttcctcaaatgaaattccaagtgaggggccaataaatgaagcagataaaactgcatgtactgtgtttgcccactcccacaccttcctgctacctgtcccatctctgaggaccctcaagactcctaggagcacagtctgatgttctcctgacatggatatcctctgactaattgcctgcttccctgaatatctcgaggctattgggccaggctgatcctggaagctgaggggaggcctccccactcctcatgccctgtacttctgggtctgggaaagcagggagtatggtgggactttgaatccaaagtccctgtactttccactgccctacctagatgtccctgtacctcctgtaaaatcagcatagagcctggtgcctggtagtccctacaaatattcacaaattggagcttagctcagctctcagggggccaatcagggggccaatcattaactggctttatctttgtgaaccatcctggggggcccaggtcatcgccccagcttccagcccaggcccagggggctgctgggggaaggggcccttcttgctgggaggtagggggcgccttgggtccctgcctcttttttttcctgggacttccccgaaggaactcacattgcagtcaactcagtgacaacctagttacatagttgcttcaaataaagactaaagcaggatccaagccaacagatcccccaacccctagtcatctttggcacgcattatgtaatttcttgcttttctttttttttaaccaggggtggggtaaacccatttccctatttgtttctgttttactttagccagatgatagtgggtttgcattctctaagagtttgctcacgaatgggggtgggaacaggagacagggaagggaaaaacatttatatgatacctactctgggcaaggagcttagctgatgtttgctgtttccatatatttccctacaaccctgggaggtaagaaccatgaacctcattttacagatgaggaaactgaggctcagacaagataagtgaattgtccaagtctcaaagcttggaagtgttgaaccaagatcaaacccagcctgtctggctttttccattactcgctatgggggtggtggggtggagaaaggggagtgggtgggtggctgaggcttttcacagtgagggttcatcaagctggtgtctttcctgaaaggacagaggtctggcatctcaggtaacagaggaagcggttccctacctgctgggatttgaggggttcataagaactgcttctcccttccatcacttggtgctgagccccagatttcaccactagtgctagatttctttgagttaagcactgccctctccaagaggcttttaaaacacacaggccctggaagatgtgacatttggtatcagtcatctcatctggagtgtttgagggagatgttacaggctcacagagcctcagagcttagggagtggaacctcatgctttacccaggagaagcctgaggtccagcaaggggagctgactcggccaaggtcacacagcatgcaacagactctggaaatttttttttttttttagacggagtctcgctttgtcgcccaggctggagtgcagtggtgccatcttggcttacttgcctcctgggtttaagtgattctcctgcctcagcctcccaagtagttggtactataggcatgcacaaccacgcctggctaacttttgtatttttagtagagacagggtttcaccatgttggccaggctgatcttgaactcctgacctcaggtgatctgcccatctcggcctcccaaagtgctgagattacagacgtgagccaccacacccagccagactcaggacttttttgcccagtgctgtttcgaagtcgccacatgcctgtgacaggtagacaggagggctctgggtaccaggtaatgaagtgagggattaaagctggaggaaatgtatctttctgctttatgccttggcccagctgagtggccctgtgctcgtcacaggctggtgtcctctgctctcctcccctcactcctggggcaagcaacagtggtgttccatgtgtgagctggacctaccactagtgttggcttgtttaaattctctgacagagacaaactgtcccggggggcggggaaggcagtgtggagctcaccccctgagggagcagcattgtctctgtgggctttggctgggaatgtttctgaagacgccctaatcccttgccctgcctagcctcaaagtctctatcactcagaggagtactgggagggctcagtgtgagccatcagaaccttccagggtatcttcccttgcttgttctctttgcgcagtccacttggtttgctaaactcctgctcttccatcaagacccaactcaaggccaggcacggtggctcacgcctgtaatcccagcactctgggaggcagaggtgggccgatcacttgaggtcaggagttcgagaccagcctgggcaacatggtgaaacaccatctctactaaaaacacaaaaattagccaggtgtggtggcaggcacctgcagtcccagctactccggaggctgaggcaggagaattgctcgaacctgggaggcaggggttgcagtgagccgacatggcgccactgcactccagtctgggcgacagagtgagaccctatctcaaaaaaaaaaaaaaaaaaaaaagacccaactcaagtatcatctccaggaagccttcccctactcccagcaattaaatgctcctcagagaattcccatttttggtttactctttggtttacctccagacaggaagcccccactgacactgttgtagtcccagggtgcaacacaaagcagagatcacaagctgagtttaataattgcttgtggaatacatgtcccaagccacctcctgcaggaagcccttccagatgcccattctagccagtctggctctttgcttccataccttcacaacacttgtgcctcccccagggcctctttctcatcttgctttctggggcagctgtgtgcacatttgtctgtgtgcagcaactctctaaggcagggatttttactcctatttttgatgaggggagctgtggctcagagaggttgaataacctaaggccacacagtgagtggcagagccaggaatgtgacttgggtccatttgaatccaaagtccctgtactttccactgccctacctagatgtccctgtacctcctataaaatcagcatggagcctggtgcctggtagtccctacaaatattcacaaattggagcttagctcagctctcaggcaaggcccaggtcaaaagggcagatacagctttgggaccttagttgccaccacatgccataccttcttcccagcagaaggactccctccaagacagggtaggggtggaggatgtgaacaggggcagaaatgggcatgttttggggtcagacttggaggaatagcagagattggagtgtcagaaggtgagcatgcctgggggtgttggggagatgcaattcatcagggacagcttagtgtcaggggattagactggggcccatgaaggagaggcagaggctgatgggcctaggggtggtgtgggtaggtgagcttccccagacagtgactctgccctgccctctctccagctaggtcctcttccccattccttccccctttcctgactggatcctcttgggagagttaccctccttggcttcctctgctccaatctttttatcagttggccatcattacttatcattacctcaagtcaaacctccagatccacatggggctaggacattggcactggaccaaagaggccctttcctttgctttctctttgtctttttaatgctttgttgcaaagacctaggcggggagagagagagagagagagagacagagattgacccacagtcagggtcagggaattgaggggaaccaacccaattctctctccttcaattcaccaggtttgtatcctgcccttcctgcagatcagtgtcctgctagtcacctgggggtcaggggatggagtgaaggacaagacctccttccattgcagtgaagccacttggagaaatgtgtggaaaacagcaagacccagtgactctctcctcaccttctttccaatctcaggagagattttgtcccttcatccaccggcttctagattaaccacccacacccacacaggcgagagtttccctgaatattggaggtgacaggacatcaggacaaagtacaactattgtgccttggcccaatcactactttctttgtctggggccgccgctggctcctggctgcctttcgcacttttctccacccccacccctttctccccttccccctcacctggaacaccttccccttcctccttggctccttctgaactgccttcagagccacagactgtggggagtggccactgcgctcccaaggtgaggccctccaagcggggccgagtttgcccctcaactgggagccagcatgacctctgtgtgggctgctctctgcttcactgccccttcccccaatctgctaggtgaccctgggcccctttgtgccctctctgggccttcggaggattctttggggagacagtctgctctgacgccccttcccctgcagcaagcagcctggggagggaggtgaggataagtgaagtcaagttgttcagggggctaagcccatggaagggaagatgccaca

SEQ ID NO: 914 - DNA, 1458 bp, Artificial Sequence
  Synthetic Oligonucleotide
aatacggtatcagtcattttagggaagtcacgactataggatggcatcaggaaaaaaaaaggaacatttttcaaatgtggctctaacattacttcagctgctaatggtatttgtttaagtttctgtattttggtgtataaatagattggagtaatatgtgttccttataataattggttatatgagaggcagttccacgtagtgtaatagaacacatattggaatacaaaagtcagaagatctgggttcaggtttgtttcacttaattgattggttcatggtcttagaacacttagcttctctgagccttggcgtcaacatttataaaaatggtgataataatgtttttcttattttattccctactgggtcattgtaaggatcaattgaggcaatgttttaaaactactagtcatgtatcagttgttcttgtagtttaatattaagagccagatactaacaaggttactaaagaattttctggctgttgtcctcattgaggcaaacataaggtgaaggcagcaagaatgcagggcttgtgtacttatagccccccacatccagtttatccagcccatgttctgttgctcacctctgctgagcacgtttttctgctcactttgtctggccttgctttccttcagcccaagaacagtacaagggtgggctgtaacaggagggccaggagatttgtgtatgcatactcgcatggctacctggaccactcacaacctcttttcctcctttgtctctgcctgtagctgccaatgactatagcaatagcaccttttattgccttgttcaaggatttctgaggcttttgaaagtttcattttctctcattctgcagagcaaataccagagataagagagtaggctggtagatggagttgggtttggtgctcaatgaaaggagataaggtccttgaattgcagtatctagcctcttctaagacaggttacgtgatgtagatcctattttaacatgctctttctttgtgtttgcagggagtcgacgagttgaagatgaagcccagagcggagtgctgttctcccaagttctggttggtgttggccgtcctggccgtgtcaggcagcagagctcgttctcagaagagcccccccagcattggcattgctgtcatcctcgtgggcacttccgacgaggtggccatcaaggatgcccacgagaaagatgatttccaccatctctccgtggtaccccgggtggaactggtagccatgaatgagaccgacccaaagagcatcatcacccgcatctgtgatctcatgtctgaccggaagatccagggggtggtgtttgctgatgacacagaccaggaagccatcgcccagatcctcgatttcatttcagcacagactctcacccccatcctgggcatccacgggggctcctctatgataatggcagataaggtaaaaaggggctgcagggag

SEQ ID NO: 915 - DNA, 3055 bp, Artificial Sequence
  Synthetic Oligonucleotide
cgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgaggatccaacatttccaatcactagtgaattatctagaagcaaatattgctatcatatttttttagtttagttatacttccatgagatattcaacaagtatcaacctcaattaaatgcagataaatttaagttgttgaataactaattatttgtcgtcttaacaaaataatgtcgtcaaatataaaactatcaaaaatgttgctacatgagtgtttacaacgttttttattatgtaatgggttagtagtttatttaacactttacttgtcgttgatttaaataataacaaaataaacgtcgtcttttaaaattttacgttttctaaaattttctagtttcataacaaattagctgtcgctttttagcttgaatagtggtattataattttatttagtacatttgcactaaataatacatccttataccgaaaagttgccgcgtccattgaggggtcaactgctttaggaagtttggatgttctcgcacaatagcgagattgtgattactgttttgagtatgaatcaagttttcctatgcccggacctaacttgtcgggaccacccggggtagtcatcgggcttatacaagtttcaacaactatcccagctagggatgagttgaaagagcgtcagaaaatatttaacagagggttgaaaggtgcatccgacttgtaagcatatttatgaatattatcagggaagtcatcaaataaagatttagctatatttcctgtacaatagatgtctgcaaacactttatcaaattggttagacgacattaatttgttaacgtttcgcaattagcattatacgacactaatttgttaacagtgacattaatttgttaatagcgacagcaatctgttaacaacgacaaataattagttattcgacataagttaaagccagcagctggatttgaacctgcgaccttccgattacaagtcggatgcactaccactgtgctatgctggcattattaagctcaccgatttatgattataacataagcaaaatatttgtctagaggaagctgcgaaaaaaatttgcttggatgttcgagactggaaggttagtacttcaacctacgtagagacgtagcaatgctacctctctacaatggttttgtatggtgcactctcagtacaatctgctctatggtgcactctcagtacaatcttgtagcaccgcctacatacctcgctctgctaatcctgttaccagccggttgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacttgagagcttagtacgtgaaacatgagagcttagtacgtactatcaacaggttgaactgcccatgttctttcctgcgttatcagagcttatcggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccaagatcccctgattccctttgtcaacagcaatggataattcgatttaacaaatgcatggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatgg

SEQ ID NO: 916 - RNA, 308 nt, Artificial Sequence
  Synthetic Oligonucleotide
  misc_feature (286)..(308): n is a, c, g, or u
auauuuuuauaacagcgccgcaguucaugcuuuuuuaagccaauguacugugaaaaaucuggguuaguuuggcgguuggaaggccgucaugcuuucugacccuuguagcugcccgcuucugaugcugccaucuuuagaauucuauaggugggauaggugcgcucccagcaauaaggaguaaggcuuuuagcuauagccguuauucauaacggugcggauuaccacagugguggcuacugaaucacccccuucgucgggggaacccuccaaaagguggguugaaagnnnnnnnnnnnnnnnnnnnnnnn

SEQ ID NO: 917 - DNA, 6241 bp, Artificial Sequence
  Synthetic Oligonucleotide
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgaaggacgactactggcagagatgggtgcagaacctgtggggcgacgagcccattcctgaagaactgcagcccgagatcgagagactgctgagcccttctgtggtggaactggaacacatccagaagatccacgactggctggacggcctgagactgtctaagcagtgcggcagaattgtggcccctcctagagccggcaagagcgtgacatgtgacgtgtaccggctgctgaacaagccccagaagagaggcggcaagcgggatattgtgcccgtgctgtatatgcaggtccccggcgattgctctagcggagaactgctggtgctgatcctggaaagcctgaagtacgatgccaccagcggcaagctgaccgacctgagaagaagagtgcagcgcctgctgaaagaaagcaaggtggaaatgctgattatcgacgaggccaacttcctcaagctgaacaccttcagcgagatcgcccggatctacgacctgctgagaatcagcatcgtgctcgtgggcaccgacggcctggacaacctgattaagagagagccctacatccacgaccggttcatcgagtgctacaagctgcccctggtggaaagcgagaagaaattcaccgagctggtcaagatctgggaagaagaggtgctctgcctgcctctgcctagcaacctgaccagaagcgagacactggaacccctgcggagaaagaccggcggaaagatcggactggtggacagagtgctgcggagagcctctattctggccctgagaaagggcctgaagaatatcgacaaagaaaccctgaccgaggtgctggattggttcgagtgaaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 918 - DNA, 6771 bp, Artificial Sequence
  Synthetic Oligonucleotide
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgtatccgtatgatgttccggattatgcaggtggcggaagcggcccaaagaagaagcggaaggtcggtggcggaagcggcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggaggaggtggaagcggaggaggaggaagcggaggaggaggtagcgaaatcggagccgaggaaccccacatcttcgaggtggaacctctggaaggcgagagcctgtctcacttcctgggcagattcagaagagagaactacctgaccagcagccagctgggcaagctgacaggactgggagctgtggtgtcccggtggaagaagctgtacttcaacccatttccaacgcggcaagagctggaagccctgacctctgtcgtcagagtgaacgccgatagactggccgagatgctgcctcctaagggcgtgaccatgaagcccagacctatcagactgtgcgccgcctgttatgccgaggtgccctgtcacagaatcgagtggcagttcaaggacgtgatgaagtgcgaccggcacaacctgagactgctgaccaagtgcaccaactgcgagacaagcttccccattcctgccgaatgggtgcagggcgagtgccctcactgctttctgccttttgccaccatggccaagcggcagaaacacggctaagaattcgatatcaagcttatcggtaatcaaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 919 - DNA, 8175 bp, Artificial Sequence
  Synthetic Oligonucleotide
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgtatccgtatgatgttccggattatgcaggtggcggaagcggcccaaagaagaagcggaaggtcggtggcggaagcggcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggaggaggtggaagcggaggaggaggaagcggaggaggaggtagcagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggaccggatcaacaatctgttccccagacctagcaagagcagataccagggccagccttctatcctcgtgggcgtgtccttcggcctgaaaaagcctgtgacagtggccgtggtggacgtggtcaagaatgaggtgctggcctacagaagcgtgaaacagctgctgggcgagaactacaatctgctgaaccggcagcgacagcagcagcagagactgtctcacgagagacacaaggcccagaagcagaacgcccctaacagctttggcgagtctgagctgggccagtacatcgacagactgctggctgacgccatcattgccattgccaagacataccaggccggctccatcgtgctgcccaagctgagagatatgagagagcagatcagcagcgagatccagagcagagccgagaagaagtgccccggctacaaagaggtgcagcagaagtacgccaaagaataccggatgagcgtgcaccggtggtcctacggcagactgatcgagtgcatcaagagccaggccgccaaggccggaatctctacagagatcggcacccagcctatccggggctctcctcaagagaaggccagagatgtggccgtgttcgcctaccaagaaagacaggccgctctgatctgagaattcgatatcaagcttatcggtaatcaaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 920 - DNA, 7251 bp, Artificial Sequence
  Synthetic Oligonucleotide
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgtatccgtatgatgttccggattatgcaggtggcggaagcggcccaaagaagaagcggaaggtcggtggcggaagcggcgacgagatgcccatcgtgaagcaggacgacgagagcctgcctgtggaaaacaacgacgatgtggatgagatccaggacgatgagctggaagagacaaacgtgatcttcaccgagctgagcgccgaggccaagctgaagatggatgtgattcagggcctgctggaaccctgcgacagaaagacatacggcgagaagctgagagtggccgccgagaaactgggaaagacagtgcggacagtgcagcggctggtcaagaagtatcagcaggacggcctgagcgccatcgtggaaacccagagaaacgacaagggcagctaccggatcgaccccgagtggcagaaattcatcgtgaacaccttcaaagagggcaacaagggctccaagaagatgacccctgctcaggtggccatgagagtgcaagttcgggctgaacagctgggcctgcagaaatttcccagccacatgaccgtgtaccgggtgctgaaccccatcatcgagcggcaagagcggaagcagaagcagagaaacatcggctggcggggcagcagagtgtcccacaagacaagagatggccagacactggacgtgcggtacagcaatcacgtgtggcagtgcgaccacaccaagctggatgtcatgctggtggaccagtacggcgagcctcttgccagaccatggttcaccaagatcaccgacagctacagccggtgcatcatgggcatccacgtgggctttgatgcccctagctctcaggttgtggccctggcctctagacacgccattctgcctaagcagtacagcgccgagtacaaactgatcagcgactggggcacctacggcgtgcccgagaatctgtttacagacggcggcagagacttcagaagcgagcacctgaagcagatcggcttccagctgggcttcgagtgtcacctgagagacagacctagcgaaggcggcatcgaggaaagaagcttcggaacaatcaataccgagttcctgagcggcttctacggctacctgggcagcaacatccaagagagaagcaagaccgccgaggaagaggcctgtctgacactgagagagctgcatctgctgctcgtgcgctacatcgtggacaactacaaccagaggctggacgcccggaccaaggaccagaccagatttcagagatgggaggccggactgcctgctctgcccaagatggtcaaagagcgcgagctggacatctgcctgatgaagaaaacccggcggagcatctacaaaggcggctatctgagcttcgagaacatcatgtaccggggcgattacctggccgcctatgccggcgagaatatcgtgctgagatacgaccccagagacatcaccaccgtgtgggtgtacagaatcgataagggcaaagaggtgttcctgtccgccgctcatgccctggattgggagacagaacagctgtccctggaagaagccaaggccgcctctagaaaagtgcggagcgtgggcaagaccctgagcaacaagtctatcctggccgagatccacgaccgggacacctttatcaagcagaagaagaagtcccagaaagagcgcaagaaagaggaacaggcccaggtccacgccgtgtacgagcctatcaatctgagcgagacagagcccctggaaaacctgcaagagacacccaagcctgtgaccagaaagccccggatcttcaactacgagcagctgcggcaggactacgacgagtaagaattcgatatcaagcttatcggtaatcaaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 921 - DNA, 12880 bp, Artificial Sequence
  Synthetic Oligonucleotide
aattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggaccggatcaacaatctgttccccagacctagcaagagcagataccagggccagccttctatcctcgtgggcgtgtccttcggcctgaaaaagcctgtgacagtggccgtggtggacgtggtcaagaatgaggtgctggcctacagaagcgtgaaacagctgctgggcgagaactacaatctgctgaaccggcagcgacagcagcagcagagactgtctcacgagagacacaaggcccagaagcagaacgcccctaacagctttggcgagtctgagctgggccagtacatcgacagactgctggctgacgccatcattgccattgccaagacataccaggccggctccatcgtgctgcccaagctgagagatatgagagagcagatcagcagcgagatccagagcagagccgagaagaagtgccccggctacaaagaggtgcagcagaagtacgccaaagaataccggatgagcgtgcaccggtggtcctacggcagactgatcgagtgcatcaagagccaggccgccaaggccggaatctctacagagatcggcacccagcctatccggggctctcctcaagagaaggccagagatgtggccgtgttcgcctaccaagaaagacaggccgctctgatcagcggcagcgagactcccgggacctcagagtccgccacacccgaaagtggacctggatctcctgccggctctcctacctctacagaggaaggttctcctgctggcagcccaaagaagaagcggaaggtcggtggcggaagcggcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaaggaaggcagaggcagcctgcttacatgtggcgacgtggaagagaaccccggacctccaaagaagaagcggaaggtcagcggcagcgagactcccgggacctcagagtccgccacacccgaaagtggacctggatctcctgccggctctaaggacgactactggcagagatgggtgcagaacctgtggggcgacgagcccattcctgaagaactgcagcccgagatcgagagactgctgagcccttctgtggtggaactggaacacatccagaagatccacgactggctggacggcctgagactgtctaagcagtgcggcagaattgtggcccctcctagagccggcaagagcgtgacatgtgacgtgtaccggctgctgaacaagccccagaagagaggcggcaagcgggatattgtgcccgtgctgtatatgcaggtccccggcgattgctctagcggagaactgctggtgctgatcctggaaagcctgaagtacgatgccaccagcggcaagctgaccgacctgagaagaagagtgcagcgcctgctgaaagaaagcaaggtggaaatgctgattatcgacgaggccaacttcctcaagctgaacaccttcagcgagatcgcccggatctacgacctgctgagaatcagcatcgtgctcgtgggcaccgacggcctggacaacctgattaagagagagccctacatccacgaccggttcatcgagtgctacaagctgcccctggtggaaagcgagaagaaattcaccgagctggtcaagatctgggaagaagaggtgctctgcctgcctctgcctagcaacctgaccagaagcgagacactggaacccctgcggagaaagaccggcggaaagatcggactggtggacagagtgctgcggagagcctctattctggccctgagaaagggcctgaagaatatcgacaaagaaaccctgaccgaggtgctggattggttcgagtgagatatcgaattgggatccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaaccatgccaaagaagaagcggaaggtcggtggcggaagcggcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggaggaggtggaagcggaggaggaggaagcggaggaggaggtagcgaaatcggagccgaggaaccccacatcttcgaggtggaacctctggaaggcgagagcctgtctcacttcctgggcagattcagaagagagaactacctgaccagcagccagctgggcaagctgacaggactgggagctgtggtgtcccggtggaagaagctgtacttcaacccatttccaacgcggcaagagctggaagccctgacctctgtcgtcagagtgaacgccgatagactggccgagatgctgcctcctaagggcgtgaccatgaagcccagacctatcagactgtgcgccgcctgttatgccgaggtgccctgtcacagaatcgagtggcagttcaaggacgtgatgaagtgcgaccggcacaacctgagactgctgaccaagtgcaccaactgcgagacaagcttccccattcctgccgaatgggtgcagggcgagtgccctcactgctttctgccttttgccaccatggccaagcggcagaaacacggcgaaggcagaggcagcctgcttacatgtggcgacgtggaagagaaccccggacctccaaagaagaagcggaaggtcggtggcggaagcggcgacgagatgcccatcgtgaagcaggacgacgagagcctgcctgtggaaaacaacgacgatgtggatgagatccaggacgatgagctggaagagacaaacgtgatcttcaccgagctgagcgccgaggccaagctgaagatggatgtgattcagggcctgctggaaccctgcgacagaaagacatacggcgagaagctgagagtggccgccgagaaactgggaaagacagtgcggacagtgcagcggctggtcaagaagtatcagcaggacggcctgagcgccatcgtggaaacccagagaaacgacaagggcagctaccggatcgaccccgagtggcagaaattcatcgtgaacaccttcaaagagggcaacaagggctccaagaagatgacccctgctcaggtggccatgagagtgcaagttcgggctgaacagctgggcctgcagaaatttcccagccacatgaccgtgtaccgggtgctgaaccccatcatcgagcggcaagagcggaagcagaagcagagaaacatcggctggcggggcagcagagtgtcccacaagacaagagatggccagacactggacgtgcggtacagcaatcacgtgtggcagtgcgaccacaccaagctggatgtcatgctggtggaccagtacggcgagcctcttgccagaccatggttcaccaagatcaccgacagctacagccggtgcatcatgggcatccacgtgggctttgatgcccctagctctcaggttgtggccctggcctctagacacgccattctgcctaagcagtacagcgccgagtacaaactgatcagcgactggggcacctacggcgtgcccgagaatctgtttacagacggcggcagagacttcagaagcgagcacctgaagcagatcggcttccagctgggcttcgagtgtcacctgagagacagacctagcgaaggcggcatcgaggaaagaagcttcggaacaatcaataccgagttcctgagcggcttctacggctacctgggcagcaacatccaagagagaagcaagaccgccgaggaagaggcctgtctgacactgagagagctgcatctgctgctcgtgcgctacatcgtggacaactacaaccagaggctggacgcccggaccaaggaccagaccagatttcagagatgggaggccggactgcctgctctgcccaagatggtcaaagagcgcgagctggacatctgcctgatgaagaaaacccggcggagcatctacaaaggcggctatctgagcttcgagaacatcatgtaccggggcgattacctggccgcctatgccggcgagaatatcgtgctgagatacgaccccagagacatcaccaccgtgtgggtgtacagaatcgataagggcaaagaggtgttcctgtccgccgctcatgccctggattgggagacagaacagctgtccctggaagaagccaaggccgcctctagaaaagtgcggagcgtgggcaagaccctgagcaacaagtctatcctggccgagatccacgaccgggacacctttatcaagcagaagaagaagtcccagaaagagcgcaagaaagaggaacaggcccaggtccacgccgtgtacgagcctatcaatctgagcgagacagagcccctggaaaacctgcaagagacacccaagcctgtgaccagaaagccccggatcttcaactacgagcagctgcggcaggactacgacgagtaa

SEQ ID NO: 922 - DNA, 12823 bp, Artificial Sequence
  Synthetic Oligonucleotide
aattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggaccggatcaacaatctgttccccagacctagcaagagcagataccagggccagccttctatcctcgtgggcgtgtccttcggcctgaaaaagcctgtgacagtggccgtggtggacgtggtcaagaatgaggtgctggcctacagaagcgtgaaacagctgctgggcgagaactacaatctgctgaaccggcagcgacagcagcagcagagactgtctcacgagagacacaaggcccagaagcagaacgcccctaacagctttggcgagtctgagctgggccagtacatcgacagactgctggctgacgccatcattgccattgccaagacataccaggccggctccatcgtgctgcccaagctgagagatatgagagagcagatcagcagcgagatccagagcagagccgagaagaagtgccccggctacaaagaggtgcagcagaagtacgccaaagaataccggatgagcgtgcaccggtggtcctacggcagactgatcgagtgcatcaagagccaggccgccaaggccggaatctctacagagatcggcacccagcctatccggggctctcctcaagagaaggccagagatgtggccgtgttcgcctaccaagaaagacaggccgctctgatcagcggcagcgagactcccgggacctcagagtccgccacacccgaaagtggacctggatctcctgccggctctcctacctctacagaggaaggttctcctgctggcagcccaaagaagaagcggaaggtcggtggcggaagcggcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaaggaaggcagaggcagcctgcttacatgtggcgacgtggaagagaaccccggacctccaaagaagaagcggaaggtcggtggcggaagcggcaaggacgactactggcagagatgggtgcagaacctgtggggcgacgagcccattcctgaagaactgcagcccgagatcgagagactgctgagcccttctgtggtggaactggaacacatccagaagatccacgactggctggacggcctgagactgtctaagcagtgcggcagaattgtggcccctcctagagccggcaagagcgtgacatgtgacgtgtaccggctgctgaacaagccccagaagagaggcggcaagcgggatattgtgcccgtgctgtatatgcaggtccccggcgattgctctagcggagaactgctggtgctgatcctggaaagcctgaagtacgatgccaccagcggcaagctgaccgacctgagaagaagagtgcagcgcctgctgaaagaaagcaaggtggaaatgctgattatcgacgaggccaacttcctcaagctgaacaccttcagcgagatcgcccggatctacgacctgctgagaatcagcatcgtgctcgtgggcaccgacggcctggacaacctgattaagagagagccctacatccacgaccggttcatcgagtgctacaagctgcccctggtggaaagcgagaagaaattcaccgagctggtcaagatctgggaagaagaggtgctctgcctgcctctgcctagcaacctgaccagaagcgagacactggaacccctgcggagaaagaccggcggaaagatcggactggtggacagagtgctgcggagagcctctattctggccctgagaaagggcctgaagaatatcgacaaagaaaccctgaccgaggtgctggattggttcgagtgagatatcgaattgggatccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaaccatgccaaagaagaagcggaaggtcggtggcggaagcggcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaagggaggaggtggaagcggaggaggaggaagcggaggaggaggtagcgaaatcggagccgaggaaccccacatcttcgaggtggaacctctggaaggcgagagcctgtctcacttcctgggcagattcagaagagagaactacctgaccagcagccagctgggcaagctgacaggactgggagctgtggtgtcccggtggaagaagctgtacttcaacccatttccaacgcggcaagagctggaagccctgacctctgtcgtcagagtgaacgccgatagactggccgagatgctgcctcctaagggcgtgaccatgaagcccagacctatcagactgtgcgccgcctgttatgccgaggtgccctgtcacagaatcgagtggcagttcaaggacgtgatgaagtgcgaccggcacaacctgagactgctgaccaagtgcaccaactgcgagacaagcttccccattcctgccgaatgggtgcagggcgagtgccctcactgctttctgccttttgccaccatggccaagcggcagaaacacggcgaaggcagaggcagcctgcttacatgtggcgacgtggaagagaaccccggacctccaaagaagaagcggaaggtcggtggcggaagcggcgacgagatgcccatcgtgaagcaggacgacgagagcctgcctgtggaaaacaacgacgatgtggatgagatccaggacgatgagctggaagagacaaacgtgatcttcaccgagctgagcgccgaggccaagctgaagatggatgtgattcagggcctgctggaaccctgcgacagaaagacatacggcgagaagctgagagtggccgccgagaaactgggaaagacagtgcggacagtgcagcggctggtcaagaagtatcagcaggacggcctgagcgccatcgtggaaacccagagaaacgacaagggcagctaccggatcgaccccgagtggcagaaattcatcgtgaacaccttcaaagagggcaacaagggctccaagaagatgacccctgctcaggtggccatgagagtgcaagttcgggctgaacagctgggcctgcagaaatttcccagccacatgaccgtgtaccgggtgctgaaccccatcatcgagcggcaagagcggaagcagaagcagagaaacatcggctggcggggcagcagagtgtcccacaagacaagagatggccagacactggacgtgcggtacagcaatcacgtgtggcagtgcgaccacaccaagctggatgtcatgctggtggaccagtacggcgagcctcttgccagaccatggttcaccaagatcaccgacagctacagccggtgcatcatgggcatccacgtgggctttgatgcccctagctctcaggttgtggccctggcctctagacacgccattctgcctaagcagtacagcgccgagtacaaactgatcagcgactggggcacctacggcgtgcccgagaatctgtttacagacggcggcagagacttcagaagcgagcacctgaagcagatcggcttccagctgggcttcgagtgtcacctgagagacagacctagcgaaggcggcatcgaggaaagaagcttcggaacaatcaataccgagttcctgagcggcttctacggctacctgggcagcaacatccaagagagaagcaagaccgccgaggaagaggcctgtctgacactgagagagctgcatctgctgctcgtgcgctacatcgtggacaactacaaccagaggctggacgcccggaccaaggaccagaccagatttcagagatgggaggccggactgcctgctctgcccaagatggtcaaagagcgcgagctggacatctgcctgatgaagaaaacccggcggagcatctacaaaggcggctatctgagcttcgagaacatcatgtaccggggcgattacctggccgcctatgccggcgagaatatcgtgctgagatacgaccccagagacatcaccaccgtgtgggtgtacagaatcgataagggcaaagaggtgttcctgtccgccgctcatgccctggattgggagacagaacagctgtccctggaagaagccaaggccgcctctagaaaagtgcggagcgtgggcaagaccctgagcaacaagtctatcctggccgagatccacgaccgggacacctttatcaagcagaagaagaagtcccagaaagagcgcaagaaagaggaacaggcccaggtccacgccgtgtacgagcctatcaatctgagcgagacagagcccctggaaaacctgcaagagacacccaagcctgtgaccagaaagccccggatcttcaactacgagcagctgcggcaggactacgacgagtaa

SEQ ID NO: 923 - DNA, 12121 bp, Artificial Sequence
  Synthetic Oligonucleotide
aattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggaccggatcaacaatctgttccccagacctagcaagagcagataccagggccagccttctatcctcgtgggcgtgtccttcggcctgaaaaagcctgtgacagtggccgtggtggacgtggtcaagaatgaggtgctggcctacagaagcgtgaaacagctgctgggcgagaactacaatctgctgaaccggcagcgacagcagcagcagagactgtctcacgagagacacaaggcccagaagcagaacgcccctaacagctttggcgagtctgagctgggccagtacatcgacagactgctggctgacgccatcattgccattgccaagacataccaggccggctccatcgtgctgcccaagctgagagatatgagagagcagatcagcagcgagatccagagcagagccgagaagaagtgccccggctacaaagaggtgcagcagaagtacgccaaagaataccggatgagcgtgcaccggtggtcctacggcagactgatcgagtgcatcaagagccaggccgccaaggccggaatctctacagagatcggcacccagcctatccggggctctcctcaagagaaggccagagatgtggccgtgttcgcctaccaagaaagacaggccgctctgatcagcggcagcgagactcccgggacctcagagtccgccacacccgaaagtggacctggatctcctgccggctctcctacctctacagaggaaggttctcctgctggcagcccaaagaagaagcggaaggtcggtggcggaagcggcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaaggaaggcagaggcagcctgcttacatgtggcgacgtggaagagaaccccggacctccaaagaagaagcggaaggtcagcggcagcgagactcccgggacctcagagtccgccacacccgaaagtggacctggatctcctgccggctctaaggacgactactggcagagatgggtgcagaacctgtggggcgacgagcccattcctgaagaactgcagcccgagatcgagagactgctgagcccttctgtggtggaactggaacacatccagaagatccacgactggctggacggcctgagactgtctaagcagtgcggcagaattgtggcccctcctagagccggcaagagcgtgacatgtgacgtgtaccggctgctgaacaagccccagaagagaggcggcaagcgggatattgtgcccgtgctgtatatgcaggtccccggcgattgctctagcggagaactgctggtgctgatcctggaaagcctgaagtacgatgccaccagcggcaagctgaccgacctgagaagaagagtgcagcgcctgctgaaagaaagcaaggtggaaatgctgattatcgacgaggccaacttcctcaagctgaacaccttcagcgagatcgcccggatctacgacctgctgagaatcagcatcgtgctcgtgggcaccgacggcctggacaacctgattaagagagagccctacatccacgaccggttcatcgagtgctacaagctgcccctggtggaaagcgagaagaaattcaccgagctggtcaagatctgggaagaagaggtgctctgcctgcctctgcctagcaacctgaccagaagcgagacactggaacccctgcggagaaagaccggcggaaagatcggactggtggacagagtgctgcggagagcctctattctggccctgagaaagggcctgaagaatatcgacaaagaaaccctgaccgaggtgctggattggttcgagtgagatatcgaattgggatccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaaccatgccaaagaagaagcggaaggtcggtggcggaagcggcgaaatcggagccgaggaaccccacatcttcgaggtggaacctctggaaggcgagagcctgtctcacttcctgggcagattcagaagagagaactacctgaccagcagccagctgggcaagctgacaggactgggagctgtggtgtcccggtggaagaagctgtacttcaacccatttccaacgcggcaagagctggaagccctgacctctgtcgtcagagtgaacgccgatagactggccgagatgctgcctcctaagggcgtgaccatgaagcccagacctatcagactgtgcgccgcctgttatgccgaggtgccctgtcacagaatcgagtggcagttcaaggacgtgatgaagtgcgaccggcacaacctgagactgctgaccaagtgcaccaactgcgagacaagcttccccattcctgccgaatgggtgcagggcgagtgccctcactgctttctgccttttgccaccatggccaagcggcagaaacacggcgaaggcagaggcagcctgcttacatgtggcgacgtggaagagaaccccggacctccaaagaagaagcggaaggtcggtggcggaagcggcgacgagatgcccatcgtgaagcaggacgacgagagcctgcctgtggaaaacaacgacgatgtggatgagatccaggacgatgagctggaagagacaaacgtgatcttcaccgagctgagcgccgaggccaagctgaagatggatgtgattcagggcctgctggaaccctgcgacagaaagacatacggcgagaagctgagagtggccgccgagaaactgggaaagacagtgcggacagtgcagcggctggtcaagaagtatcagcaggacggcctgagcgccatcgtggaaacccagagaaacgacaagggcagctaccggatcgaccccgagtggcagaaattcatcgtgaacaccttcaaagagggcaacaagggctccaagaagatgacccctgctcaggtggccatgagagtgcaagttcgggctgaacagctgggcctgcagaaatttcccagccacatgaccgtgtaccgggtgctgaaccccatcatcgagcggcaagagcggaagcagaagcagagaaacatcggctggcggggcagcagagtgtcccacaagacaagagatggccagacactggacgtgcggtacagcaatcacgtgtggcagtgcgaccacaccaagctggatgtcatgctggtggaccagtacggcgagcctcttgccagaccatggttcaccaagatcaccgacagctacagccggtgcatcatgggcatccacgtgggctttgatgcccctagctctcaggttgtggccctggcctctagacacgccattctgcctaagcagtacagcgccgagtacaaactgatcagcgactggggcacctacggcgtgcccgagaatctgtttacagacggcggcagagacttcagaagcgagcacctgaagcagatcggcttccagctgggcttcgagtgtcacctgagagacagacctagcgaaggcggcatcgaggaaagaagcttcggaacaatcaataccgagttcctgagcggcttctacggctacctgggcagcaacatccaagagagaagcaagaccgccgaggaagaggcctgtctgacactgagagagctgcatctgctgctcgtgcgctacatcgtggacaactacaaccagaggctggacgcccggaccaaggaccagaccagatttcagagatgggaggccggactgcctgctctgcccaagatggtcaaagagcgcgagctggacatctgcctgatgaagaaaacccggcggagcatctacaaaggcggctatctgagcttcgagaacatcatgtaccggggcgattacctggccgcctatgccggcgagaatatcgtgctgagatacgaccccagagacatcaccaccgtgtgggtgtacagaatcgataagggcaaagaggtgttcctgtccgccgctcatgccctggattgggagacagaacagctgtccctggaagaagccaaggccgcctctagaaaagtgcggagcgtgggcaagaccctgagcaacaagtctatcctggccgagatccacgaccgggacacctttatcaagcagaagaagaagtcccagaaagagcgcaagaaagaggaacaggcccaggtccacgccgtgtacgagcctatcaatctgagcgagacagagcccctggaaaacctgcaagagacacccaagcctgtgaccagaaagccccggatcttcaactacgagcagctgcggcaggactacgacgagtaa

SEQ ID NO: 924 - DNA, 12028 bp, Artificial Sequence
  Synthetic Oligonucleotide
aattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggaccggatcaacaatctgttccccagacctagcaagagcagataccagggccagccttctatcctcgtgggcgtgtccttcggcctgaaaaagcctgtgacagtggccgtggtggacgtggtcaagaatgaggtgctggcctacagaagcgtgaaacagctgctgggcgagaactacaatctgctgaaccggcagcgacagcagcagcagagactgtctcacgagagacacaaggcccagaagcagaacgcccctaacagctttggcgagtctgagctgggccagtacatcgacagactgctggctgacgccatcattgccattgccaagacataccaggccggctccatcgtgctgcccaagctgagagatatgagagagcagatcagcagcgagatccagagcagagccgagaagaagtgccccggctacaaagaggtgcagcagaagtacgccaaagaataccggatgagcgtgcaccggtggtcctacggcagactgatcgagtgcatcaagagccaggccgccaaggccggaatctctacagagatcggcacccagcctatccggggctctcctcaagagaaggccagagatgtggccgtgttcgcctaccaagaaagacaggccgctctgatcagcggcagcgagactcccgggacctcagagtccgccacacccgaaagtggacctggatctcctgccggctctcctacctctacagaggaaggttctcctgctggcagcccaaagaagaagcggaaggtcggtggcggaagcggcgtgagtaaaggtgaagaactcttcactggagtagtgcccattctggtagagcttgatggagatgtaaatggacataaattctccgtcaggggcgaaggcgaaggggacgccacgaatggtaagctgactctgaaattcatctgtacgacgggcaaactgcccgtcccatggcctacactcgtaacgaccctcacctacggcgtgcaatgcttttctcgatatcccgaccacatgaaacagcatgactttttcaagtctgcaatgcctgaaggttatgttcaagaaaggaccatcagctttaaggatgatggtacatataaaacccgagccgaggttaaatttgaaggggacactctggttaatcgaattgaactgaaaggtattgattttaaggaggacggtaacatactggggcacaagttggagtacaactttaacagccataatgtgtatattaccgctgataagcagaaaaatgggataaaggccaactttaagatccgacataatgtcgaagatggtagtgttcaactggctgatcattaccaacaaaatacgcccatcggagatggacctgtactcttgcctgacaatcattatctctccacgcaatcaaagctttccaaggacccaaacgaaaagagagatcacatggtccttctggaatttgtgactgccgcaggcatcactctcggtatggatgagctgtacaaggaaggcagaggcagcctgcttacatgtggcgacgtggaagagaaccccggacctaaggacgactactggcagagatgggtgcagaacctgtggggcgacgagcccattcctgaagaactgcagcccgagatcgagagactgctgagcccttctgtggtggaactggaacacatccagaagatccacgactggctggacggcctgagactgtctaagcagtgcggcagaattgtggcccctcctagagccggcaagagcgtgacatgtgacgtgtaccggctgctgaacaagccccagaagagaggcggcaagcgggatattgtgcccgtgctgtatatgcaggtccccggcgattgctctagcggagaactgctggtgctgatcctggaaagcctgaagtacgatgccaccagcggcaagctgaccgacctgagaagaagagtgcagcgcctgctgaaagaaagcaaggtggaaatgctgattatcgacgaggccaacttcctcaagctgaacaccttcagcgagatcgcccggatctacgacctgctgagaatcagcatcgtgctcgtgggcaccgacggcctggacaacctgattaagagagagccctacatccacgaccggttcatcgagtgctacaagctgcccctggtggaaagcgagaagaaattcaccgagctggtcaagatctgggaagaagaggtgctctgcctgcctctgcctagcaacctgaccagaagcgagacactggaacccctgcggagaaagaccggcggaaagatcggactggtggacagagtgctgcggagagcctctattctggccctgagaaagggcctgaagaatatcgacaaagaaaccctgaccgaggtgctggattggttcgagtgagatatcgaattgggatccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaaccatgccaaagaagaagcggaaggtcggtggcggaagcggcgaaatcggagccgaggaaccccacatcttcgaggtggaacctctggaaggcgagagcctgtctcacttcctgggcagattcagaagagagaactacctgaccagcagccagctgggcaagctgacaggactgggagctgtggtgtcccggtggaagaagctgtacttcaacccatttccaacgcggcaagagctggaagccctgacctctgtcgtcagagtgaacgccgatagactggccgagatgctgcctcctaagggcgtgaccatgaagcccagacctatcagactgtgcgccgcctgttatgccgaggtgccctgtcacagaatcgagtggcagttcaaggacgtgatgaagtgcgaccggcacaacctgagactgctgaccaagtgcaccaactgcgagacaagcttccccattcctgccgaatgggtgcagggcgagtgccctcactgctttctgccttttgccaccatggccaagcggcagaaacacggcgaaggcagaggcagcctgcttacatgtggcgacgtggaagagaaccccggacctccaaagaagaagcggaaggtcggtggcggaagcggcgacgagatgcccatcgtgaagcaggacgacgagagcctgcctgtggaaaacaacgacgatgtggatgagatccaggacgatgagctggaagagacaaacgtgatcttcaccgagctgagcgccgaggccaagctgaagatggatgtgattcagggcctgctggaaccctgcgacagaaagacatacggcgagaagctgagagtggccgccgagaaactgggaaagacagtgcggacagtgcagcggctggtcaagaagtatcagcaggacggcctgagcgccatcgtggaaacccagagaaacgacaagggcagctaccggatcgaccccgagtggcagaaattcatcgtgaacaccttcaaagagggcaacaagggctccaagaagatgacccctgctcaggtggccatgagagtgcaagttcgggctgaacagctgggcctgcagaaatttcccagccacatgaccgtgtaccgggtgctgaaccccatcatcgagcggcaagagcggaagcagaagcagagaaacatcggctggcggggcagcagagtgtcccacaagacaagagatggccagacactggacgtgcggtacagcaatcacgtgtggcagtgcgaccacaccaagctggatgtcatgctggtggaccagtacggcgagcctcttgccagaccatggttcaccaagatcaccgacagctacagccggtgcatcatgggcatccacgtgggctttgatgcccctagctctcaggttgtggccctggcctctagacacgccattctgcctaagcagtacagcgccgagtacaaactgatcagcgactggggcacctacggcgtgcccgagaatctgtttacagacggcggcagagacttcagaagcgagcacctgaagcagatcggcttccagctgggcttcgagtgtcacctgagagacagacctagcgaaggcggcatcgaggaaagaagcttcggaacaatcaataccgagttcctgagcggcttctacggctacctgggcagcaacatccaagagagaagcaagaccgccgaggaagaggcctgtctgacactgagagagctgcatctgctgctcgtgcgctacatcgtggacaactacaaccagaggctggacgcccggaccaaggaccagaccagatttcagagatgggaggccggactgcctgctctgcccaagatggtcaaagagcgcgagctggacatctgcctgatgaagaaaacccggcggagcatctacaaaggcggctatctgagcttcgagaacatcatgtaccggggcgattacctggccgcctatgccggcgagaatatcgtgctgagatacgaccccagagacatcaccaccgtgtgggtgtacagaatcgataagggcaaagaggtgttcctgtccgccgctcatgccctggattgggagacagaacagctgtccctggaagaagccaaggccgcctctagaaaagtgcggagcgtgggcaagaccctgagcaacaagtctatcctggccgagatccacgaccgggacacctttatcaagcagaagaagaagtcccagaaagagcgcaagaaagaggaacaggcccaggtccacgccgtgtacgagcctatcaatctgagcgagacagagcccctggaaaacctgcaagagacacccaagcctgtgaccagaaagccccggatcttcaactacgagcagctgcggcaggactacgacgagtaa

SEQ ID NO: 925 - DNA, 11494 bp, Artificial Sequence
  Synthetic Oligonucleotide
aattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggaccggatcaacaatctgttccccagacctagcaagagcagataccagggccagccttctatcctcgtgggcgtgtccttcggcctgaaaaagcctgtgacagtggccgtggtggacgtggtcaagaatgaggtgctggcctacagaagcgtgaaacagctgctgggcgagaactacaatctgctgaaccggcagcgacagcagcagcagagactgtctcacgagagacacaaggcccagaagcagaacgcccctaacagctttggcgagtctgagctgggccagtacatcgacagactgctggctgacgccatcattgccattgccaagacataccaggccggctccatcgtgctgcccaagctgagagatatgagagagcagatcagcagcgagatccagagcagagccgagaagaagtgccccggctacaaagaggtgcagcagaagtacgccaaagaataccggatgagcgtgcaccggtggtcctacggcagactgatcgagtgcatcaagagccaggccgccaaggccggaatctctacagagatcggcacccagcctatccggggctctcctcaagagaaggccagagatgtggccgtgttcgcctaccaagaaagacaggccgctctgatcagcggcagcgagactcccgggacctcagagtccgccacacccgaaagtccaaagaagaagcggaaggtcggtggcggaagcggcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccacatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgactaa

SEQ ID NO: 926 - DNA, 11491 bp, Artificial Sequence
  Synthetic Oligonucleotide
aattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccacatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacggtggcggaagcggcccaaagaagaagcggaaggtcggaggaggtggaagcggaggaggaggaagcggaggaggaggtagcagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggaccggatcaacaatctgttccccagacctagcaagagcagataccagggccagccttctatcctcgtgggcgtgtccttcggcctgaaaaagcctgtgacagtggccgtggtggacgtggtcaagaatgaggtgctggcctacagaagcgtgaaacagctgctgggcgagaactacaatctgctgaaccggcagcgacagcagcagcagagactgtctcacgagagacacaaggcccagaagcagaacgcccctaacagctttggcgagtctgagctgggccagtacatcgacagactgctggctgacgccatcattgccattgccaagacataccaggccggctccatcgtgctgcccaagctgagagatatgagagagcagatcagcagcgagatccagagcagagccgagaagaagtgccccggctacaaagaggtgcagcagaagtacgccaaagaataccggatgagcgtgcaccggtggtcctacggcagactgatcgagtgcatcaagagccaggccgccaaggccggaatctctacagagatcggcacccagcctatccggggctctcctcaagagaaggccagagatgtggccgtgttcgcctaccaagaaagacaggccgctctgatctaa

SEQ ID NO: 927 - DNA, 10858 bp, Artificial Sequence
  Synthetic Oligonucleotide
aattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggacagcggcagcgagactcccgggacctcagagtccgccacacccgaaagtccaaagaagaagcggaaggtcggtggcggaagcggcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccacatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgactaa

SEQ ID NO: 928 - DNA, 10855 bp, Artificial Sequence
  Synthetic Oligonucleotide
aattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccacatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacggtggcggaagcggcccaaagaagaagcggaaggtcggaggaggtggaagcggaggaggaggaagcggaggaggaggtagcagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggactaa

SEQ ID NO: 929 - protein, 9 aa, Artificial Sequence
  Synthetic Peptide
LAGLIDADG

SEQ ID NO: 930 - RNA, 145 nt, Cyanobacteria species
cucccaagggggaaacuagcccccacuaagucaucggugaugucgucauguaggcgccggaauaacgacccucgcguggauaggacagauaacugucgucguagucccacucgucgauggucccagucuuucguucugacauaaa

SEQ ID NO: 931 - RNA, 12 nt, Cyanobacteria species
guggguugaaag

SEQ ID NO: 932 - RNA, 115 nt, Cyanobacteria species
aaauacagucuugcuuucugacccugguagcugcucacccugaugcugcugucaauagacaggauaggugcgcucccagcaauaaggccgcggauguacugcuguaguggcuacu

SEQ ID NO: 933 - RNA, 12 nt, Cyanobacteria species
guggguugaaag

SEQ ID NO: 934 - RNA, 89 nt, Cyanobacteria species
agacagcauaggugcgcucccagcaauaagggcgcggauguacugcuguaguggcuacugaaucacccccgaucaagggggaacccucc

SEQ ID NO: 935 - RNA, 12 nt, Cyanobacteria species
guggguugaaag

SEQ ID NO: 936 - RNA, 81 nt, Cyanobacteria species; identical to SEQ ID NO: 4

SEQ ID NO: 937 - RNA, 12 nt, Cyanobacteria species
guggguugaaag

SEQ ID NO: 938 - RNA, 165 nt, Artificial Sequence
  Synthetic Oligonucleotide
uuaaaugaggguuaguuugacuguauaaauacagucuugcuuucugacccugguagcugcucacccugaugcugcugucaauagacaggauaggugcgcucccagcaauaagggcgcauacugcuguaguggcuacugaaucacccccgaucaagggggaacccu

SEQ ID NO: 939 - RNA, 13 nt, Artificial Sequence
  Synthetic Oligonucleotide
gguggguugaaac

SEQ ID NO: 940 - RNA, 184 nt, Artificial Sequence
  Synthetic Oligonucleotide
uuaaaugaggguuaguuugacuguauaaauacagucuugcuuucugacccugguagcugcucacccugaugcugcugucaauagacaggauaggugcgcucccagcaauaagggcgcauacugcuguacucgcuacugaaucacccccgaucaagggggaacccuccaaaagguggguucaaac

SEQ ID NO: 941 - DNA, 31 bp, Escherichia coli
  misc_feature (1)..(6): n is a, c, g, or t
nnnnnngagaagtcatttaataaggccactg

SEQ ID NO: 942 - DNA, 37 bp, Artificial Sequence; identical to SEQ ID NO: 31
  Synthetic Oligonucleotide

SEQ ID NO: 943 - DNA, 37 bp, Artificial Sequence
  Synthetic Oligonucleotide
ctttcaacccacccctagtcgggatggtagttgaaac

SEQ ID NO: 944 - protein, 584 aa, Scytonema hofmanni
MNSQQNPDLAVHPLAIPMEGLLGESATTLEKNVIATQLSEEAQVKLEVIQSLLEPCDRTTYGQKLREAAEKLNVSLRTVQRLVKNWEQDGLVGLTQTSRADKGKHRIGEFWENFITKTYKEGNKGSKRMTPKQVALRVEAKARELKDSKPPNYKTVLRVLAPILEKQQKAKSIRSPGWRGTTLSVKTREGKDLSVDYSNHVWQCDHTRVDVLLVDQHGEILSRPWLTTVIDTYSRCIMGINLGFDAPSSGVVALALRHAILPKRYGSEYKLHCEWGTYGKPEHFYTDGGKDFRSNHLSQIGAQLGFVCHLRDRPSEGGVVERPFKTLNDQLFSTLPGYTGSNVQERPEDAEKDARLTLRELEQLLVRYIVDRYNQSIDARMGDQTRFERWEAGLPTVPVPIPERDLDICLMKQSRRTVQRGGCLQFQNLMYRGEYLAGYAGETVNLRFDPRDITTILVYRQENNQEVFLTRAHAQGLETEQLALDEAEAASRRLRTAGKTISNQSLLQEVVDRDALVATKKSRKERQKLEQTVLRSAAVDESNRESLPSQIVEPDEVESTETVHSQYEDIEVWDYEQLREEYGF

SEQ ID NO: 945 - protein, 276 aa, Scytonema hofmanni
MTEAQAIAKQLGGVKPDDEWLQAEIARLKGKSIVPLQQVKTLHDWLDGKRKARKSCRVVGESRTGKTVACDAYRYRHKPQQEAGRPPTVPVVYIRPHQKCGPKDLFKKITEYLKYRVTKGTVSDFRDRTIEVLKGCGVEMLIIDEADRLKPETFADVRDIAEDLGIAVVLVGTDRLDAVIKRDEQVLERFRAHLRFGKLSGEDFKNTVEMWEQMVLKLPVSSNLKSKEMLRILTSATEGYIGRLDEILREAAIRSLSRGLKKIDKAVLQEVAKEYK

SEQ ID NO: 946 - protein, 167 aa, Scytonema hofmanni
MIEAPDVKPWLFLIKPYEGESLSHFLGRFRRANHLSASGLGTLAGIGAIVARWERFHFNPRPSQQELEAIASVVEVDAQRLAQMLPPAGVGMQHEPIRLCGACYAESPCHRIEWQYKSVWKCDRHQLKILAKCPNCQAPFKMPALWEDGCCHRCRMPFAEMAKLQKV

SEQ ID NO: 947 - protein, 639 aa, Scytonema hofmanni
MSQITIQARLISFESNRQQLWKLMADLNTPLINELLCQLGQHPDFEKWQQKGKLPSTVVSQLCQPLKTDPRFAGQPSRLYMSAIHIVDYIYKSWLAIQKRLQQQLDGKTRWLEMLNSDAELVELSGDTLEAIRVKAAEILAIAMPASESDSASPKGKKGKKEKKPSSSSPKRSLSKTLFDAYQETEDIKSRSAISYLLKNGCKLTDKEEDSEKFAKRRRQVEIQIQRLTEKLISRMPKGRDLTNAKWLETLLTATTTVAEDNAQAKRWQDILLTRSSSLPFPLVFETNEDMVWSKNQKGRLCVHFNGLSDLIFEVYCGNRQLHWFQRFLEDQQTKRKSKNQHSSGLFTLRNGHLVWLEGEGKGEPWNLHHLTLYCCVDNRLWTEEGTEIVRQEKADEITKFITNMKKKSDLSDTQQALIQRKQSTLTRINNSFERPSQPLYQGQSHILVGVSLGLEKPATVAVVDAIANKVLAYRSIKQLLGDNYELLNRQRRQQQYLSHERHKAQKNFSPNQFGASELGQHIDRLLAKAIVALARTYKAGSIVLPKLGDMREVVQSEIQAIAEQKFPGYIEGQQKYAKQYRVNVHRWSYGRLIQSIQSKAAQTGIVIEEGKQPIRGSPHDKAKELALSAYNLRLTRRS

SEQ ID NO: 948 - DNA, 1755 bp, Scytonema hofmanni
atgaacagtcagcaaaatcctgatttagctgttcatcccttggcaattcctatggaaggcttactaggagaaagtgctacaactcttgagaagaatgtaattgccacacaactctcagaggaagcccaagtaaagctagaggtaatccaaagtttactggaaccctgcgatcgcacaacttatgggcaaaagttgcgggaagcagcagagaaactaaatgtatcgttgcgaacggtacaaaggttggtgaaaaactgggaacaagatggcttagtcggactcactcaaacaagtagggctgataaaggaaaacaccgcattggtgagttttgggaaaacttcattaccaaaacctacaaggagggtaacaagggaagtaaacgtatgacccctaaacaagttgctctcagagtcgaggctaaagcccgtgaattaaaagactctaagccgcccaattacaaaaccgtgttacgggtattagcacccattttggaaaagcaacaaaaagccaagagtatccgcagtcctggttggagaggaactacgctttcggttaaaacccgtgaaggaaaagatttatcggttgattacagtaaccatgtttggcaatgtgaccatacccgcgtggatgtgttgctggtagatcaacatggtgaaattttaagtcgtccctggctaacaacagtaattgatacttactctcgttgcattatgggtatcaacttgggctttgatgcacccagttctggggtagtagcattagcgttacgccatgcaattctaccaaagcgttacggttccgagtacaaactgcattgtgagtggggaacctatggaaaaccagaacatttttatactgatggcggtaaagactttcgctctaaccacttgagtcagattggggcgcaattgggatttgtctgtcatttacgcgatcgcccttctgaaggtggagtagtagaacgtcccttcaaaacattaaatgaccaactattttcaacgcttcctgggtacaccggatctaatgtgcaggaacgcccagaagatgcagagaaggacgcaagacttactttgcgagaactagaacagttacttgtgcgttacatcgtagatcgttacaaccaaagtattgatgcgcggatgggcgaccaaacgcgctttgagcgttgggaagcaggattgcctacagtgccagtaccaataccagaacgagatttggatatttgtttaatgaagcagtcacggcgcactgtgcaaagaggtggttgtttgcagtttcagaatttaatgtatcggggggaatatttggcaggttatgccggagaaactgtcaacttaaggtttgaccccagagacattacaacaattttggtttatcgccaggaaaacaatcaggaagtatttctgactcgcgctcacgctcaaggtttggagacagagcaactggcattagatgaggctgaggcagcaagtcgcagactccgtaccgcagggaaaactatcagtaaccaatcattattgcaagaagttgttgaccgcgatgctcttgtcgctaccaagaaaagccgtaaggagcgtcaaaaattggaacagactgttttgcgatctgctgctgttgatgaaagtaatagagaatccttgccttctcaaatagttgaaccagatgaagtggaatctacagaaacggttcactctcaatacgaagacattgaggtgtgggactatgaacaacttcgtgaagaatatgggttttaa

SEQ ID NO: 949 - DNA, 827 bp, Scytonema hofmanni
atgacagaagctcaggcgatcgccaagcagttgggtggggtaaaaccggatgatgagtggttacaagctgaaattgctcgtctcaagggtaagagcattgtgcctttacagcaggtaaaaactctccatgattggttagatggcaagcgcaaggcaagaaaatcttgccgagtagttggggaatcgagaactggcaagacagttgcttgtgatgcctacagatacaggcacaaacctcagcaggaagctggacgacctccaactgtgcctgtcgtttatattcgacctcaccaaaaatgtggccccaaggatttgtttaaaaagattactgagtacctcaagtatcgggtaacaaaagggactgtatctgattttcgagataggacgatagaagtactcaagggttgtggcgtagagatgctaattattgatgaagctgaccgtctcaagcctgaaacttttgctgatgtgcgagatattgccgaagatttaggaattgctgtggtactggtaggaacagaccgtttggatgcggtaattaagcgggatgagcaggttctcgaacgctttcgggcgcatcttcgctttggtaaattgtcgggagaggattttaagaacaccgtagaaatgtgggaacaaatggttttgaaactgccagtatcttctaatctaaagagcaaggagatgctacggattctcacgtcagcaactgaaggctacattggtcgccttgatgagattcttagggaagctgcaattcgttccttatcaagaggattgaagaagattgacaaggctgttttacaggaagtagctaaggagtacaa

SEQ ID NO: 950 - DNA, 504 bp, Scytonema hofmanni
atgatagaagcaccagatgttaaaccttggctattcttgattaaaccctatgaaggggaaagcctgagccactttcttggcaggttcagacgtgccaaccatttatccgcaagtggattgggtactttggcaggaattggtgctatagtggcacgttgggaaagatttcattttaatcctcgccctagtcagcaagaattggaagcgatcgcatctgtagtagaagtggcagctcaaaggttagcccagatgttaccgcctgctggagtgggaatgcagcatgagccaattcgcttgtgtggggcttgttatgccgagtcgccttgtcaccgaattgaatggcagtacaagtcggtgtggaagtgcgatcgccatcaactcaagattttagcaaagtgtccaaactgtcaagcaccttttaaaatgcctgcgctgtgggaggatgggtgctgtcacagatgtaggatgccgtttgcagaaatggcaaagctacagaaggtttga

SEQ ID NO: 951 - DNA, 1920 bp, Scytonema hofmanni
atgagtcaaataactattcaagctcgacttatttcctttgaatcaaaccgccaacaactctggaagttgatggcagatttaaacacgccgttaattaacgaactgctttgccagttaggtcaacaccccgacttcgagaagtggcaacaaaagggtaaactcccgtctaccgttgtgagccagttatgtcaacctctcaaaactgaccctcgctttgcaggtcagcccagccgtttatatatgtcggcaattcatattgtggactacatctacaagtcctggctggctatacagaaacggcttcaacagcagctagatggaaagacgcgctggctagaaatgctcaatagcgatgctgaattagtagaacttagtggtgacactttagaggctattcgtgtcaaagctgctgaaattttggcaatagctatgccagcatctgagtcagatagcgcttcacctaaagggaaaaaaggtaaaaaggagaaaaaaccctcatcttctagccctaagcgtagtttatccaagacattatttgacgcttaccaagaaacggaagatatcaagagccgtagcgccatcagctacctgttaaaaaatggctgcaaacttactgacaaagaagaagattcagaaaaatttgctaaacgtcgtcgtcaagttgaaatccaaattcaaaggcttaccgaaaagttaataagtcggatgcctaaaggtcgagatttgaccaatgctaaatggttggagacactcttgactgctacaaccactgttgctgaagacaacgcccaagccaaacgctggcaggatattctgttaactcgatcaagttctctcccattcccccttgtttttgaaaccaacgaggatatggtttggtcaaagaatcaaaagggtaggctgtgtgttcacttcaatggcttaagcgatttaatttttgaggtgtactgcggcaatcgtcaacttcactggtttcaacgcttcctagaagaccaacagactaaacgcaaaagcaaaaatcagcattctagcggcttgttcacactcagaaatggtcatctagtttggcttgaaggtgagggtaaaggggaaccttggaatcttcaccacttgaccctttactgctgtgttgacaatcgcttgtggacagaggagggaacagaaatcgttcgccaagagaaagcagatgaaattactaaattcatcacaaacatgaagaagaaaagcgatctaagcgatacacagcaagctttgattcaacgtaaacaatcaacacttactcgaataaacaattcctttgagcgtcctagccaacccctttatcaaggtcaatcacacattttggttggagtaagcctgggactagaaaaacctgccacagtagcagtagtagatgcgatcgccaacaaagtcttggcttaccggagtattaaacaattacttggcgacaattacgaactgctaaatcgccagagacgacaacagcagtacctatctcacgaacgccacaaagcacaaaaaaacttctctcccaatcaatttggagcatctgagttagggcaacatatagacagattattagctaaagcaattgtagcgttagcgagaacctacaaagctggcagtattgtcttgcccaagttaggggatatgcgggaggttgtccaaagtgaaattcaagctatagcagaacaaaaatttcccggttatattgaaggtcagcaaaaatatgccaaacagtaccgggttaatgttcatcggtggagctacggcagattaattcaaagcattcaaagtaaagcagctcaaacaggaattgtgattgaggagggaaaacaacctattcgaggtagtccccacgacaaagcaaaggaattagcactttctgcttacaatctccgcctaactaggcgaagttaa

SEQ ID NO: 952 - DNA, 1866 bp, Anabaena cylindrica
atggcagacgaagaatttgaatttactgaaggaacgacgcaagttccagatgctattttgcttgacaagagtaattttgtggtagatccatcccaaattattctggcaacgtcggatagacataaactgacatttaatctaatccagtggcttgctgaatctcccaaccgcactattaagtctcagagaaaacaggcagttgcaaatacccttgatgtttctactcgccaggtggaacgtcttctcaagcaatacgatgaagacaagttaagagagacagcaggaatagaacgagccgataagggaaaatatcgagttagcgaatattggcaaaacttcatcacaacaatctatgaaaagagtctgaaagaaaaacatccaatatcaccagcatccatagttcgtgaagtgaagcgacacgcaattgtggatcttgaacttaagctaggagaatatcctcatcaagccactgtttatagaattttagatcctttaatcgagcaacagaaacggaaaacaagagttagaaatccgggttcgggatcttggatgacagtagtaacacgagatggagagttacttagggctgactttagtaaccaaattattcagtgtgaccatactaaattggatgttcgcatagttgataatcatggcaatttactgtctgatcgtccttggctaactactattgtggatactttttcaagctgtgttgttggttttcgcttatggattaaacaacccggttctacagaggtggctttagctttaagacacgctattttacctaaaaactaccctgaagattatcaacttaataagtcttgggatgtatgtggacacccctatcaatatttttttactgatggtggtaaagattttcgctcaaaacatctcaaagctattggtaagaaattaggatttcagtgtgaattacgcgatcgcccaccggaaggtggtattgtggaacggattttcaaaactattaatactcaagttctcaaagagttacctggttatacaggggcaaatgttcaggaacgcccagaaaatgcagagaaagaagcctgtttaactattcaggatttggataagattctcgctagtttcttttgtgatatctataatcacgagccttatcctaaagagcctcgtgatacgagatttgaacgctggtttaagggtatgggaggaaaactacctgaacctttggatgagcgagaattagatatttgtttgatgaaagaagcccaacgagttgttcaagctcatggatctattcaatttgaaaacctgatttatcggggagaatttctcaaagcacataaaggtgaatatgtaacgctgagatatgatccagatcatatcctgagtttatatatctacagtggtgaaactgatgataatgcaggagaatttttgggttatgctcatgccgttaatatggatacccatgatttaagtatagaagaattaaaagccctgaataaagagagaagtaatgctcgtaaggagcattttaactatgatgctttattagcattgggtaaacgtaaagaacttgtagaggaacggaaagaggataaaaaggcaaaaagaaactcagaacaaaagcgtctccgttctgcatccaagaaaaattccaatgttattgaactacgcaaaagtaggacttccaaatctttgaagaaacaagaaaatcaggaagttttaccagagagaatttccagggaagaaatcaagcttgagaagatagaacagcaaccacaggaaaatctatcagcttcacctaacactcaagaagaagagagacataagttagttttctctaaccgtcaaaaaaatttgaacaagatttggtaa

SEQ ID NO: 953 - DNA, 852 bp, Anabaena cylindrica
atggcgcaacctcaacttgcaactcaatctattgttgaagtcctagccccaaggttagacatcaaagctcaaattgctaaaactattgatattgaagagatttttagagcttgttttatcactactgatcgggcttcggaatgcttcagatggttagatgaattgcgtattctcaaacaatgtggtcgaatcattggaccaagaaatgtgggaaaaagcagagccgcgcttcactatcgagatgaggataaaaaacgagtttcctatgtaaaggcttggtctgcatcgagttctaagcggctattttcacaaatcctgaaggatattaatcatgctgcaccaacaggtaaacgacaggatttacgtccaagattagcgggtagtctggaactatttggattggaattggtgattatagataatgcggaaaatcttcaaaaagaagcactgctagacttgaaacaactttttgaagagtgtaatgttcctattgttttagctggaggtaaggagttagatgatcttttacacgattgtgatttgttgactaatttcccaacactctatgagtttgaacggttggaatatgatgatttcaaaaaaacattaactacaattgaattggatgttttatctcttccagaagcatctaatttagctgagggcaatatttttgagattttagcagttagtacagaagcacgaatgggaattttaatcaagatactaactaaggctgttttacattctctcaaaaatggatttcaccgagttgatgaaagtattttagaaaaaattgctagtcgttatggcacaaaatatattcctctcaaaaacagaaatagggattga

SEQ ID NO: 954 - DNA, 555 bp, Anabaena cylindrica
atggcacaaaatatattcctctcaaaaacagaaatagggattgatgaagatgatgaaattcgcccaaagttaggctatgttgaaccttatgaggaggagagtattagtcattatctagggcgtttgcgacggtttaaggctaacagcctaccgtcaggatactctttgggaaaaattgctggactcggtgcaatgatttcacgttgggagaagctttatttcaatccttttcctactctacaagagttggaggctttgtcctctgtggtgggagttaatgcagatagattaatagaaatgctcccctctcagggaatgacgatgaagcctagaccaattaggttatgtggggcttgttatgcagaatctccttgtcatcggattgagtggcagtgtaaggatagaatgaaatgcgatcgccacaatttacgtttattaataaaatgtactaattgtgaaactcctttcccgattcccgcagattgggttaaaggtcaatgtcctcattgttccctgccttttgcaaagatggcgaaaaggcaaaggcgtgattag

SEQ ID NO: 955 - DNA, 1929 bp, Anabaena cylindrica
atgagcgttatcacaattcaatgtcgcttggttgctgaagaagacagcctccgtcaactatgggaattgatgagtgaaaaaaatacaccattcatcaatgaaattttgctacagataggaaaacacccagaatttgaaacctggctagaaaaaggtagaataccggctgaattactcaaaacactgggtaactccctgaaaactcaagaaccttttactggacaacctggacgtttttacacctcagcgattactttagtggattatctgtataaatcctggtttgctttacagaaacgcagaaagcagcaaatagaagggaaacagcgttggctaaaaatgctcaaaagtgatcaagaacttgagcaagaaagtcaatctagcttagaagtaatccgtaataaagccactgaactttttagcaaatttacccctcagtccgatagcgaagcgctccgtaggaatcaaaatgacaaacagaaaaaggtaaaaaagactaaaaaatccacaaaaccgaaaacatcttcaattttcaaaatttttttaagcacttacgaagaagcggaagaacctcttactcgttgcgctcttgcatatctactcaaaaataactgtcaaattagtgaactggatgaaaacccagaagaatttaccagaaataagcgcagaaaagaaatagaaattgagcgattaaaagatcaactccaaagtcgcatccccaaaggtagagatttgacaggagaagaatggttagaaaccttagaaattgccaccttcaatgttccgcaaaatgaaaatgaagcaaaagcatggcaagcagcacttttaagaaaaactgctaatgttccctttcctgtagcttatgaatctaacgaggatatgacatggttaaagaatgataaaaatcgtctctttgtacggttcaatggcttgggaaaacttacttttgagatttactgcgataagcgtcatttgcactacttccaacgctttttagaggatcaagaaattctacgcaatagtaaaaggcagcactcaagcagtttgtttactctacgctcaggaagaatagcttggttgccaggtgaagaaaaaggtgaacattggaaagtaaatcaactaaatttttattgttctttagatactcgaatgctgactaccgaaggaactcaacaggtagttgaggagaaagttacagcaattaccgaaattttaaataaaacaaaacagaaagatgatctcaacgataaacaacaagcttttattactcgtcagcaatcaacactagctcgaattaataacccttttcctcgtcccagtaaacctaattatcaaggtaaatcttctatcctcataggtgttagttttggactagaaaaaccagtcacagtagcagtcgtagatgttgttaaaaataaagttatagcttatcgcagtgtcaaacaactacttggtgaaaactataatcttctgaatcgtcagcgacaacaacagcaacgcctatctcacgaacgccacaaagcccaaaaacaaaatgcacccaactcttttggtgaatctgaattaggacaatatgtggatagattgttagcagatgcaattattgcgatcgctaaaaaatatcaagctggcagtatagttttacccaaactccgcgatatgcgagagcaaatcagcagtgaaattcaatccagagcagaaaatcaatgccctggttacaaagaaggccaacaaaaatacgccaaagaatatcgaataaacgttcatcgctggagttatggacgattaatcgagagtatcaaatcccaagcagcacaagctggaattgcaattgaaactggaaaacagtcaatcagaggcagtccacaagaaaaagcacgagatttagccgtctttacttaccaagaacgtcaagctgcgctaatttag

SEQ ID NO: 956 - DNA, 1755 bp, Scytonema hofmanni; identical to SEQ ID NO: 948

SEQ ID NO: 957 - DNA, 827 bp, Scytonema hofmanni; identical to SEQ ID NO: 949

SEQ ID NO: 958 - DNA, 504 bp, Scytonema hofmanni; identical to SEQ ID NO: 950

SEQ ID NO: 959 - DNA, 1920 bp, Scytonema hofmanni; identical to SEQ ID NO: 951

SEQ ID NO: 960 - DNA, 1866 bp, Anabaena cylindrica; identical to SEQ ID NO: 952

SEQ ID NO: 961 - DNA, 852 bp, Anabaena cylindrica; identical to SEQ ID NO: 953

SEQ ID NO: 962 - DNA, 555 bp, Anabaena cylindrica; identical to SEQ ID NO: 954

SEQ ID NO: 963 - DNA, 1929 bp, Anabaena cylindrica; identical to SEQ ID NO: 955

SEQ ID NO: 964 - DNA, 1866 bp, Scytonema hofmannii
atgctggacgaggaattcgagttcaccgaggaactgacacaggcccctgacgtgatcgtgctggacaagagccacttcgtggtggaccccagccagatcatcctgcagaccagcgacaagcacaagctgcggttcaacctgatcaagtggttcgccgagtctcccaacatcaccatcaagagccagcggaagcaggccgtggttgataccctgggagtgtccaccagacaggtggaaagactgctgaagcagtaccacaacggcgagctgtctgaaacagccggcgtgcagagaagcgataagggcaagctgagaatcagccagtattgggaagattacatcaagaccacctacgagaagtccctgaaggacaagcaccccatgctgcctgccgccgtcgttagagaagtgaagagacacgccatcgtggacctgggactgaagcctggcgattaccctcatcctgccaccatctaccggaatctggcccctctgatcgagcagcacacccggaagaaaaaagtgcggaatcctggcagcggcagctggctgacagtggtcacaagagatggccagctgctgaaggccgacttcagcaaccagatcattcagtgcgaccacaccgagctggacatccacatcgtggatagccacggcagcctgctgagcgatagaccttggctgaccacagtggtggatacctacagcagctgcatcctgggctttcacctgtggatcaagcagcctggcagcaccgaagttgccctggctctgagacatgccatcctgcctaagaactaccccgaggactacaagctgggcaaagtgtgggagatctacggccctccattccagtactttttcaccgatggcggcaaggacttcaacagcaagcacctgaaggccatcggcaagaaactgggcttccagtgcgagctgcggaacagacctcctcaaggcggcattgtggaacggctgttcaagaccatcaacacccaggtgctgaaagagctgcctggctacacaggcgccaacgtgcaagagaggcctaaaaacgccgagaaagaggcctgcctgaccatccaggatctggataagatcctggccagcttcttctgcgacatctacaaccacgagccgtatcctaaagagccccggaacaccagattcgagcggtggtttaaaggcatgggcggcaagctgcctgagcctctggatgagagagagctggatatctgcctgatgaaggaagctcagagagtcgttcaggcccacggctccatccagttcgagaacctgatctacagaggcgaggccctgaaagcctacaggggcgagtatgtgaccctgagatacgaccccgatcacgtgctgaccctgtacgtgtactcttgcgaggccgacgacaacgccgaggaatttctgggatatgcccacgccatcaacatggacacccacgacctgagcatcgaggaactcaagaccctgaacaaagagcggagcaaggccagaagcgaccactacaactacgatgccctgctggccctgggcaagagaaaagaactggtggaagagaggaagcaggacaagaaggccaagcggcagagcgagcagaagagactgagaaccgccagcaagaaaaactccaatgtgatcgagctgagaaagtccagagccagcagcagctccagcaaggacgaccggcaagagatcctgcctgagagagtgtctcgggacgagctgaagcccgagaaaacagagctgaagtacgaggaaaacctgctcgcccagaccgacacacagaagcaagagcggcacaaactggtggtgtccgaccggaagaagaacctgaagaacatctggtga

SEQ ID NO: 965 - DNA, 855 bp, Scytonema hofmannii
atggccatctctcagctggccacacagcccttcgtggaagtgctgcctcctgagctggatagcaaggcccagatcgccaagaccatcgacatcgaggaactgttccggatcaacttcatcaccaccgaccggtccagcgagtgcttcagatggctggacgagctgcggatcctgaagcagtgcggcagaatcatcggccccagaaacgtgggcaagagcagagccgtgctgcactaccggaacgaggacaagaaacgggtgtcctacgtgaaggcttggagcgccagcagcagcaagagactgttcagccagattctgaaggacatcaaccacgccgcctccaccggcaagagacaggatcttagacctagactggccggcagcctggaactgtttggactggaactggtcatcgtggacaacgccgagaacctgcagaaagaggccctgctggacctcaagcagctgttcgaggaatgccacgtgccaatcgtgctcgtcggcggaaaagagctggacgacatcctggaagatttcgacctgctgaccaactttcccacactgtacgagttcgagcggctggaacacgacgacttcatcaagaccctgaaaaccatcgagctggacatcctgagcctgcctgaggcctctaagctgagcgagggcaacatctttgccatcctggccgagtctaccggcggcaagatcggcatcctggtcaagattctgaccaaggcagtgctgcacagcctgaagaaaggcttcggcaaggtggacgagtctatcctggaaaagatcgccagcagatacggcaccaaatacgtgcccatcgagaacaagaaccgcaacgactga

SEQ ID NO: 966 - DNA, 516 bp, Scytonema hofmannii
atgatcgaggacgacgagatcagactgcggctgggctacgtggaacctcatcctggcgagagcatcagccactacctgggcagactgagaagattcaaggccaacagcctgcctagcggctatgccctgggaaagattgccggactgggcagcgttctgaccagatgggagaagctgtacttcaacccatttccgacacagcaagagctggaagccctggctcaagtgatccaggtggaagtggaaaagctgagagagatgctgcccaccaagggcgtgaccatgatgcccagacctatcagactgtgcgccgcctgttatgccgagtctccctaccacagaatcgagtggcagttcaaggacaagatgaagtgcgaccggcaccagctgagactgctgaccaagtgcaccaactgtcagaccccttttcctattcctgccgactgggagaagggcgagtgcagccactgctttctgagcttcgccaagatggtcaagtgccagaaacggcggtga

SEQ ID NO: 967 - DNA, 1938 bp, Scytonema hofmannii
atgagcaccatcaccatccagtgcagactggtggccgaggaagctaccctgagatacttctgggagctgatggccgagaagaacacccctctgatcaacgagctgctggaacagctgggacagcaccccgatttcgacacatgggtgcaagccggcaagatgcccgagaaaaccgtggaaaacctgtgcaagagcctcgaggacagagagcccttcgccaatcagcccggcagattcagaacaagcgccgtggctctggtcaagtacatctacaagagttggttcgccctgcagaagcggagagccgatagactggaaggcaaagaacggtggctgaagatgctgaagtccgacgtggaactggaaagagagagcaactgcagcctggacatcatcagagccaaggccggcgagatcctggccaaagtgactgaaggatgcgcccctagcaaccagaccagcagcaagcgcaagaagaaaaagaccaagaagtcccaggccaccaaggacctgcctacactgttcgagatcatcctgaaggcctacgagcaggccgaagagagcctgacaagagccgctctggcctacctgctgaagaacgattgcgaggtgtccgaggtggacgaggacagcgagaagttcaagaagcgcagacggaagaaagagatcgagatcgagcggctgcggaaccagctgaagtctagaatccccaagggcagagatctgaccggcgacaagtggctgaaaaccctggaagaggccaccagaaacgtgccagagaacgaggatgaggccaaagcctggcaggctcagctgctgagagaagccagcagcgtgccatttcctgtggcctacgaaaccagcgaggacatgacctggttcaccaacgagcagggcagaatcttcgtgtacttcaacggcagcgccaagcacaagttccaggtgtactgcgacagacggcagctgcactggttccagagattcgtggaagatttccagatcaagaagaacggggacaagaagggcagcgagaaagagtatcctgccggcctgctgaccctgtgcagcacaagactgagatggaaagagtccgccgagaagggcgacccctggaatgtgcacagactgatcctgagctgcaccatcgacaccagactgtggacactggaagggaccgaacaagtgcgggccgagaaaatcgcccaggtggaaaagaccatctccaagcgcgagcaagaagtgaacctgagcaagacccagctggaacggctgcaggccaaacactctgagagagagcggctgaacaacatcttccccaacagacccagcaagccctcctacagaggcaagagccacattgccatcggcgtgtccttcagcctggaaaatcctgccacagtggccgtggtggacgtggccacaaagaaggtgctgacctacagaagcttcaaacagctgctgggcgacaactacaacctggccaacagactgcggcagcagaagcagagactgagccacgagagacacaaggcccagaaacagggcgctcccaacagctttggcgattctgagctgggccagtacgtggacagactgctggccaagagcatcgtggccattgccaagacataccaggccagctccatcgtgctgcccaagctgcggtacatgcgggaaatcatccacaacgaggtgcaggctaaggccgaaaagaagatccccggctacaaagagggccagaagcagtacgccaagcagtacagaatcagcgtgcaccagtggtcctacaaccggctgagccagatcctggaaagccaggccacaaaagccggcatctctatcgagaggggcagccaagtgatccagggcagctctcaagagcaggctagagatctggccctgttcgcctacaacgagaggcagctgtctctgggctaa

SEQ ID NO: 968 - DNA, 671 bp, Scytonema hofmannii
ttattaaaataccgtaccttgaaaatatcataagctaataaagaatcaatactttactacattgtttgacaggctcccaaatccccaaattcttataagttgttggggatttggtcaacctcacctaatatggtagagtactaatagcgccgcagttcatgctctttaagagtctctgtactgtggaaaatctgggttagtttgacggttggaaaaccgttttgctttctgaccctggtagctgcccgcttctcatgctctgacttttcacgttatgtggaaaaagtaacgtaatttcgttagttaagacttaccgtaaaaagtcagttctgatgctgctgtcgcaagacaggataggtgcgctcccagcaaaaggagtatgtcttgaaaaagactagccgttctagtaacggtgcggattaccgcagtggtggctactgaatcacccccttcgtcgggggaaccctcccaaatatttttttggcaaagccaagcgggggcaaaaaccctgaggtcctgccaaaacacggaagcccttgttatatcttgatttcaaaatctaggttgttaattaatttagttttttggttttaagatagagctacttttacgcagccttgccaaatatgcttgtgtaacgctctaaataataagggttttagacgggtaga

SEQ ID NO: 969 - DNA, 37 bp, Scytonema hofmannii; identical to SEQ ID NO: 819

SEQ ID NO: 970 - DNA, 723 bp, Scytonema hofmannii
  misc_feature (700)..(723): n is a, c, g, or t
ttattaaaataccgtaccttgaaaatatcataagctaataaagaatcaatactttactacattgtttgacaggctcccaaatccccaaattcttataagttgttggggatttggtcaacctcacctaatatggtagagtactaatagcgccgcagttcatgctctttaagagtctctgtactgtggaaaatctgggttagtttgacggttggaaaaccgttttgctttctgaccctggtagctgcccgcttctcatgctctgacttttcacgttatgtggaaaaagtaacgtaatttcgttagttaagacttaccgtaaaaagtcagttctgatgctgctgtcgcaagacaggataggtgcgctcccagcaaaaggagtatgtcttgaaaaagactagccgttctagtaacggtgcggattaccgcagtggtggctactgaatcacccccttcgtcgggggaaccctcccaaatatttttttggcaaagccaagcgggggcaaaaaccctgaggtcctgccaaaacacggaagcccttgttatatcttgatttcaaaatctaggttgttaattaatttagttttttggttttaagatagagctacttttacgcagccttgccaaatatgcttgtgtaacgctctaaataataagggttttagacgggtagagaaatcccggctaggggtgggttgaaagnnnnnnnnnnnnnnnnnnnnnnnn

SEQ ID NO: 971 - DNA, 500 bp, Scytonema hofmannii
tcgttctgctttccagagattggtggatgacttcccaacgacggtaagggagataactttgcgtcacccaggtgagtgcttgagagggggtagcatcgagaggtaatgcttggggttggtgtacattcgcaaattatatgtcgcaattcgcaaattagtgtcgcaattacttctaatagctgagatctttattgcgtaggacttacaagctatttatccataaaactgagtaatttgcctgtttcgcaaattagatgtcgcaaatcctattttcgcaaattaaatgtcgtttattaagatttgcctgtttcgcaaattagatgtcgcatttttgccacattagtggtactttagtacctaaagtgttaatcagtggttttcactccaatgttagacgaagaatttgagttcactgaggaattgacgcaagctccagatgttattgtgcttgacaagagtcattttgtggtagacccatcccaaattattctgcaaacatc

SEQ ID NO: 972 - DNA, 500 bp, Scytonema hofmannii
gactctgtgccttttttggagtgttgttcatgcaaaatttgagaatcttgactagaactgaaactcttgctaagtaacgctttcaacgaaaataaagccatatagtacaaatttactaaaaatcaacaaaatcaacaccctagggtaagtctgtcaattagtccagtagcaagacattatgttagacgacattaatttgttaacgttagttggaactaattcgacgacattaattcgttaacagcgacattaatttgttaatcgacactaaatggagaaacaggacgacattaatttgcgaaaagttcctataattgaattgatgagacaaactattctaaacgacattaatttgcgaaaaacgacacaaatttgcgaattacgacatttaatttgcgaatgtacatttgcggttcatttaagtaggtagtctttgggcgggaaaggagtagaaaacactataaactacttaaaagaacataatttaaaccgcagcaact

SEQ ID NO: 973 - DNA, 1710 bp, Leptolyngbya boryana
atgcagctgcccatcgagttccctgagagcgaacaggtgtcccgcgaactggtggaacagaaccagatcgtgaccgagctgagcgacgaggccaagctgaagatcgaagtgatccagagcctgctggaaccctgcgacagagccacctacggcaacagactgagagatgccgccaccagactgggcaagagcgtcagaacagtgcagcggatggtcaagagctggcaagaggaaggcattgccggcctgagcaatggcgagagaacagacaagggcgagcaccggattgagcaagagtggcaggacttcatcatcaagacctaccaagagggcaacaagaacggcaagcggatgacccctgctcaggtggccatcagagtgaaagtgaaggcccagcaagaggggatcacaaagtaccccagccacatgaccgtgtaccgggtgctgaatcccctgatccagcgcaagaccgagaagcagaatgtgcggagcatcggctggcagggctctagactgagcctgaaaaccagagatggcaacagcctgtccgtggaatactccaatcaagtgtggcagtgcgaccacaccagagccgatatcctgctggtggatcagcacggcgagctgattggtagaccttggctgaccaccgtggtggacacctacagcagatgtatcgtgggcgtgaacctgggcttcgatgccccttcttctgacgtggtggcactggccctgagacacgccattctgcccaagacataccccgacagataccagctgaactgcgactggggcacatacggcaagcccgagcacttctttaccgacggcggcaaggacttcagaagcaaccatctgcagcagatcgccgtgcagattggcttcacctgtcacctgagaaacagaccctctgaaggcggcgtggtggaaagacctttcggcaccctgaacaccgagttcttcagcatcctgcctggctacaccggcagcaacgtgcagaaaagacccgaggaagccgaggaaagcgccagcctgacactgagagagctggaacagttcctcgtgcggtacatcaccgaccggtacaaccagggaatcgacgccagaatgggcgaccagaccaggtttcagagatgggaagctggcctgctggccaatcctagcgtgctgacagagcgcgagctggacatctgcctgatgaagcagacccgcagaaccgtgtacagagagggctacctgagattcgagaacctgatctaccggggcgagaatctggccggatatgccggcgaaacagtgaccctgagatacgagcccagagacatcaccaccgtgttcgtgtaccaccaagagcagggcaaagaggtgttcctgaccagagcacacgcccaggacctggaaaccgagacaatcagcctgtatgaggccaaggccagcagccggcggattagagatgtgggcaagaccatcagcaaccggtccatcctggaagaagtgcgcgacagggatctgttcgtgcagaagaaaacacggaaagagcggcagaaggccgagcaggccgaagtgaagattgatcaggtgccaagtcctcctcaggtgctgcatctggatgaggccagccagttcgagacagagatcgtggaaacccagtgcgtggaaatcagcgagatcgaggactacgagaagctgcgggacgacttcggatggtga

SEQ ID NO: 974 - DNA, 837 bp, Leptolyngbya boryana
atgatggccaacgaggcccagtctatcgcccagacacttggaagcctgcctctgacatctgagctgctgcaggccgagatccaccggctgacaaagaaaagcgtggtgtccctgagccaggtgcagagcctgcacaattggctggaaggcaagagacaggcccggcagtcttgtagagttgtgggcgagagcagaaccggcaagaccctggcctgtgatgcctacagactgcggcacaagcctacacagcaggccggaaagcctcctatcgtgcccgtggtgtatatccaggtgccacaagagtgcggcagcaaagagctgttccagatcatcatcgagcacctgaagtaccagatggtcaagggcaccgtggccgagattcgcgagagaaccatgagagtgctgaaaggctgcggcgtggaaatgctgatcatcgacgaagccgaccggctgaagcctaagacctttgccgatgtgcgggacatcttcgacaagctggaaatcagcgtggtgctcgtgggcaccgacagactggatgccgtgatcaagagggacgaacaggtgtacaaccggttccgggcctgccacagatttggaaaactggccggcgaggaattccggcggacaatcgagatttgggagaagcagatcctgaagctgcccgtggccagcaacctgacatctaaggccgctctgaagatcctgggcgagacaacagccggctacatcggactgctggacatggtgctgagagaggccgctatcagagccctgaagcagggcaagaccaagatcgacctggaaatcctgaaagaggtgtccaccgagtaccggtga

SEQ ID NO: 975 - DNA, 519 bp, Leptolyngbya boryana
atgatcgagcacagcgagatccagccatggttctttcacgtggaagccctggaaggcgagagcatctctcactttctgggcagattccggcaggccaacgagctgacaccttctggcgtgggcaagatctctggactcggcggagctattgccagatgggagaagttccggttcaacccctatcctacacagcagcagttcgagaagctgagcaccgccacaggcatcagcgttgagcagctgtggaagatgatgcctcctgaaggcgtgggaatgcagctggaacccatcagactgtgcgccagctgttatgccgagctgccttgtcaccagatccagtggcagttcaaggacacccagggatgcgaagtgcacggcctgagactgctgagcgagtgccctaattgcaaggcccggtttaagcctcctgccacttggagcgatagcaagtgccaccggtgcttcatgctgttcagcgagatgcggaaccggcagaagagacacagcttcagcagatga

SEQ ID NO: 976 - DNA, 1911 bp, Leptolyngbya boryana
atgagcgtgatcaccatccagtgcaagctggtggccacagaagagacaagacgggccctgtggcatctgatggccgagaaacacacccctctgatcaacgagctgctgaagcacattgcccaggacagcagattcgaggaatggtccctgaccggcaagctgcctagactggtggtgtccgaggcctgcaatcagctgaagcaggaccctcagtttagcggccagcctggcagattctacagcagcgccatcagcaccgtgcaccggatctttctgtcttggctggccctgcagacccggctgagaaatcagatcagcggccagacaagatggctggccatgctgcagagcgacaatgagctgacaatcgccagccagaccgacatcaacaccctgagactgaaggccagcgaactgctgacccacctgaacgagcctatcagcgagagcgaccagcctgaagtgaagaaaacccggtccaagaagaagaaccagaccagcaatcaggctggcgccaacgtgtcccggacactgttcaagctgtacgacgagacagaggaccctctgaccagatgcgccattgcctacctgctgaagaacggctgcaaactgcccgaccagaacgagaaccccgagaagttcatcaagcggcggagaaagaccgagatccggctggaaagactgatgaacaccttccagaccacacggatccccagaggcagacacctgagctggcactcttggatcgaggccctggaaaccgccacctctcacatccccgagaacgaggaagaagctgctggctggcaagcccggctgctgacaaaacctgccatcctgccttttccagtgaactacgagacaaacgaggacctgcggtggtcactgaacagccagggcagaatctgtgtgtccttcaacggcctgagcgagcacttcttcgaggtgtactgcgaccagagggacctgcactggttcaaccggtttctggaagatcaagagacaaagaaggcctccaagaaccagcacagcagcagcctgttcagcctgagatctggacagatcgcctggcaagaaggcaagggcgacgccgaacattgggtcgtgcataggctggtgctgagctgcagcatcgagacagacacatggacccaagagggcaccgaggaaatccggcagaagaaagccagcgactgcgccaaagtgatcgccagcacaaaggccaaagagaacagaagccagaaccaggacgccttcatccggcggagagaacggatgctggaactgctggaaaatcagttccccagacctagctacccactgtaccagggacagccttctatcctggccggcgtgtcctatggcctggataagcctgccacactggccatcgtgaacatccagacaggcaaggccatcacctaccggtccatcagacagatcctggggaagaactacaagctgctcaaccggtacagactgaaccagcagcggaacgcccacaagcggcacaacaaccagagaaaaggcggcagcagccagctgagagagtccaatcagggccagtacctggacaggctgatcgcccacgagatcgtggccattgctcaagagtaccaggtgtcctctctggctctgcccgatctgggcgacatcagagaaatcgtgcagtccgaggtgcaggccagagccgagcaaaagattctgggctccatcgagcagcagaggaagtacgccagacagtacagagccagcgtgcaccgttggagatacgcccagctgacccagttcatccagagccaggctgcccaagtgggcatctctatcgagatcaccaagcagcccctgagcggcacccctcaagagaaggctagaaacctggctatcgccgcctaccagagccggaaatga

SEQ ID NO: 977 - DNA, 431 bp, Leptolyngbya boryana
aaattacttgcaattagttcaaatgtattttataaatagagtgcgccgtggttcatgctagcaatagcccctgtgccatcgacaattacgagctagtttgactgtcggaagatagtcttgctttctggctcaggttgactgtctacctcgaagttgggtgcgctcccagcaaaagggtgcgggtctaccgcaatgctggttagccaatctcacctccgagcaaggaggaatccacccctaacttttaacttgttggcaaaccgaagcgaggtcaaaatccctaggaggtttgccaatccgtacaaactaatcccttcagcagctttccacagcataaagctgcttcttgtccaacaaaaagtatcggatttagaggggtttgccaaaaccatgtttgaaaagcacactatggctgcaccttgaatggcagg

SEQ ID NO: 978 - DNA, 37 bp, Leptolyngbya boryana; identical to SEQ ID NO: 807

SEQ ID NO: 979 - DNA, 483 bp, Leptolyngbya boryana
  misc_feature (460)..(483): n is a, c, g, or t
aaattacttgcaattagttcaaatgtattttataaatagagtgcgccgtggttcatgctagcaatagcccctgtgccatcgacaattacgagctagtttgactgtcggaagatagtcttgctttctggctcaggttgactgtctacctcgaagttgggtgcgctcccagcaaaagggtgcgggtctaccgcaatgctggttagccaatctcacctccgagcaaggaggaatccacccctaacttttaacttgttggcaaaccgaagcgaggtcaaaatccctaggaggtttgccaatccgtacaaactaatcccttcagcagctttccacagcataaagctgcttcttgtccaacaaaaagtatcggatttagaggggtttgccaaaaccatgtttgaaaagcacactatggctgcaccttgaatggcagggaaattgcggcaagggggcgattgaaagnnnnnnnnnnnnnnnnnnnnnnnn

SEQ ID NO: 980 - DNA, 500 bp, Leptolyngbya boryana; identical to SEQ ID NO: 808

SEQ ID NO: 981 - DNA, 500 bp, Leptolyngbya boryana; identical to SEQ ID NO: 809

SEQ ID NO: 982 - DNA, 1668 bp, Geminocystis species
atgaccatcgagaaccagatcagcgagagccaagagctgatctcccagctgagccctgaggaacaggccattgccgacgtgatcgaggatctggtgcagccctgcgacagaaagacatacggcgccaagctgaagaaggccgccgagacactgaacaagagcgtgcgaaccgtgcagcggtacatcaaagagtgggaagagaagggcctgctggccatcaagaagggcaacagaagcgaccagggcacctaccggatcgagaagagactgcaggacttcatcgtgaaaacctaccgcgagggcaacaagggcagcaagagaatcagccccaaacaggtgtacctgcggacaatggcccaggccaaagaatggtccatcgatcctccaagccacatgaccgtgtaccggattctgaaccccatcatcgaggaaaaagaaaacaagaaacgcgtgcggaaccccggctggcggggaacaaaactggctgtgtctaccagaagcggcaacgagatcaacgtggaatactccaaccacgcctggcagtgcgatcacaccagagccgatatcctgctggtggaccagtttggccaactgctgggtagaccttggctgaccacagtggtggacacctacagcagatgcatcatgggcatcaacctgggcttcgacgcccctagctctcaggttgtgtctctggccctgagacacgccatgctgctgaagtcctacagctccgattacggcctgcacgaggaatggggcacatacggcaagcccgagtacttctacaccgacggcggcaaggacttccggtccaatcatctgcagcagatcggcctgcagctgggcttcacatgccacctgagaagcagacctagcgaaggcggcgtggtggaaagacccttcaagaccctgaacacagaggtgttcagcaccctgcctggctacacaggcggcaacgtgcaagagagatctgaggacgccgagaaggacgccagcctgacactgagacagctggaaagaatcatcgtgcgctacatcgtggacaactacaaccagcggatggacgccagaatgggcgagcagaccagattccagagatgggatagcggcctgctgagcatccctgatctgctgagcgaacgcgacctggacatctgcctgatgaagcagtctagacggcgggtgcagaaaggcggctacctgcagttcgagaacctgatgtaccagggcgagtacctggccggctatgagggcgagacagtgatcctgagatacgaccccagagacatcaccgccatcctggtgtacagaaacgaaggcaacaaagaagtgttcctgaccagagcctacggcctggacctggaaacagagagcatgagctgggaagatgccaaggccagcgccaagaaagtgcgcgagtctggcaagaacctgagcaacagatccatcctggccgaagtgaaagagcggcacaccttcagcgacaaaaagaccaagaaagagaggcagcggcaagagcaagaacaagtgaagccttatattccatctccggtgctgaaagaagtcaaagagcagaccgacaaggccaccgacaccgacatgagcgaggaacccatcgtggaagtgttcgactacagccagctccaggacgactacggcttctga

SEQ ID NO: 983 - DNA, 828 bp, Geminocystis species
atggaagccaaggctatcgcccaagagctgggcaacatcgagatccccgaagagaagctgcagatggaaatcgagcggctgaacagcaagaccctggtgtccctggaacaggtggccaagctgcacgagtacttcgagggcaagagacagagcaagcagagctgcagagtcgtgggcgagagcagaaccggaaagaccatggcctgcgacagctaccggctgagacacaagcccatccagaaagtgggacaccctcctcaggtgcccgtggtgtacatccagattcctcaggactgcggcaccaaagagctgtttcagggcatcatcgagtacctgaagtaccagatgaccaagggcacaatcgccgagatcagacagcgggccatcaaggtgttgcaaggctgcggcgtggaaatgatcatcatcgacgaggccgaccggttcaagcccaagacctttgctgaagtgcgggacatcttcgacagactgaacatccccatcgtgctcgtgggcaccgatagactggacaccgtgatcaagcgggacgaacaggtgtacaaccggttcagaagctgctacagattcggcaagctgtctggcgccgacttccagaacaccgtgaacatctgggagaaacaggtgctgaagctgcccgtggccagcaacctgatccagaccaagatgctgaaactgatcgccgaggccacaggcggctatatcggcctgatggacaccatcctgagagagagcgccatcagaagcctgaagcggggcctgaacaagatcaccttcgagatcctgaaagaagtgacccaagagttcaagtga

SEQ ID NO: 984 - DNA, 483 bp, Geminocystis species
atggacctgcagatccagaactggctgttcatcctggtgccttacgagggcgagagcatcagccactttctgggcagattcagacgggccaacagcctgtcttgtggcggactgggacaagccacaggactgtactctgccattgccagatgggagaagttccggttcaaccctccacctagcctgaagcagctggaaaagctgagcgagatcgtgcaggtcgagatggccacactgcagaccatgtttcccagcgctcccatgaagatgacccctatcagaatctgcagcgcctgctacggcgagaacccctaccatcagatgagctggcagtacaaagaaatctacagatgcgaccggcacaacctgaacatcctgagcgagtgccctaactgcgccgccagattcaagttccccaacctttggttcgagggcttctgccacagatgcttcacccctttcgagcagatgccccagagctga

SEQ ID NO: 985 - DNA, 1851 bp, Geminocystis species
atggcccacgtgaccatccagtgtagactgatcgccagccgggataccagacagttcctgtggcagctgatggcccagaagaacacccctctgatcaacgagatcctgctgcggatcaagcagcaccccgattttccccactggcggaccaagaagagactgcccaaggacttcctggccagacagatcgccgagctgaagaacaactaccccttcgaggaacagcccagccggttttacgccagcgtgaacaaagtgatcgactacatctacaagagttggttcgaggtgcagaaggccctggactggaagctgcagggcaatctgagatgggtcgaaatgctgctgcccgacaccgagctgatcaagcacttcgacaacagcctggaaagcctgcagcagcaggccacactgatcctggacagcatcgacagcaccgtgtctcacgaccggatcagcaccatcctgttcgagaagtgcggcaagacaaagaagcccgagatcaagagcgccatcatctacctgctgaagaatggctgcacaatccccaagaagcctgagacaaccgagaagtaccaggacctgaagcggaaggtggaaatcaagatcaccaagctgcaccggcagatcgagagcagaatccctctgggcagagatctcgaggacaagaagtggctggacaccctgatcaccgccagcacaacagcccctatcgatcagaccgaggccaacacctggttcagcatcctgaagcagaaccagagcagcatcccctatcctatcctgtacgagacaaacgaggatctgaagtggtccctgaacgagaagaaccggctgagcatcagattcagcggcctgggcgagcacagctttcagctgtgttgcgaccacagacagctgccctacttccagcggttctacgaggaccaagagctgaaaaaggccagcaaggaccagctgagcagcgccctgtttacactgagaagcgccatgatcctgtggaaagaggacgaaggcaagggcgagctgtgggacagacacaagctgtacctgcactgcaccttcgagacaagatgcctgacagccgagggcacctccaccatcgtggaagagaagcagaaagaagtgaccaagatcatcgacctcatgaaggccaaagaggaactgagcgacagccagcaggccttcatcagacggaagaatagcaccctggccaagctgaacaacacattccccagacctagcaagcccgtgtaccagggcaagcccaatgtgcacctgggaatcgccatgggactcgagcagcctgtgacaatcgccattgtggacatcgaaaccgacaaagtcatcacctaccggaacaccaaacagctgctgagagaggactaccgcctgctgagaagaaggcggatcgagaaacagaagctgagccaccagaaccacaaggcccggaagcggttcaacttccagcagaagggcgagagcaatctgggcgagtacctggatcggctgattgccaaggccatcctgacagtggcccaagagtaccaggtgtccaccattctgatccccagactgagagacatgcggagcatcaccgaggccgagattcagctgagagccgagaagaagatccccgagtacaaagagggccagaagaagtacgcccaggactacagagtgcaggtccaccagtggtcctacggccgcctgatcgagaacgtgaagctgatctgcgagaaagtgggcatcgtggtggtggaagccaagcagcctaagcagggaaccctgaccgaaaaggctctgcagctggtgctgagcgccaccgagaaaaacctgaagaagaagtga

SEQ ID NO: 986 - DNA, 458 bp, Geminocystis species
cacaaaatcaatttcttgagataaactggaagtaatcgtgccgcagatcaagttaaattaacccctgttctgttgttctgtgaaaaatgaggggtagtttgcctagtaataggtttgctttctgtccctgataactgctctctctgatgctgcgcactgaataaagtgcggaaacaaggggcactcccagtaataagagtttgggtttaccaatgtagttgttatcaaatcacctccgaccaaggaggaatctctatttaagcgttagttaaaatgtacgagttacacaaactctgattttagccttacgcaatcgctaaaactcttatcaattaagggatatagcgttttaataaaatgcaaaattcgatcgaaaatcagaattttagtatttttaaggggggcttacgcaaactgtcttcacaagccttgttttataaggtttctgactaggggca

SEQ ID NO: 987 - DNA, 37 bp, Geminocystis species
gttgaaataagaaaataccttctctagggattgaaag

SEQ ID NO: 988 - DNA, 510 bp, Geminocystis species
  misc_feature (487)..(510): n is a, c, g, or t
cacaaaatcaatttcttgagataaactggaagtaatcgtgccgcagatcaagttaaattaacccctgttctgttgttctgtgaaaaatgaggggtagtttgcctagtaataggtttgctttctgtccctgataactgctctctctgatgctgcgcactgaataaagtgcggaaacaaggggcactcccagtaataagagtttgggtttaccaatgtagttgttatcaaatcacctccgaccaaggaggaatctctatttaagcgttagttaaaatgtacgagttacacaaactctgattttagccttacgcaatcgctaaaactcttatcaattaagggatatagcgttttaataaaatgcaaaattcgatcgaaaatcagaattttagtatttttaaggggggcttacgcaaactgtcttcacaagccttgttttataaggtttctgactaggggcagaaaaataccttctctagggattgaaagnnnnnnnnnnnnnnnnnnnnnnnn

SEQ ID NO: 989 - DNA, 500 bp, Geminocystis species
agaaagtggacgagaagctctattttgctatccttgttttaattttggcagtaattgtttgactacttattaaaataaaattgatggaaaagttaaaaatcagtctgaaaatgcttttgaataactttgataaaaaatcttgtacagtaacagattatttgtcgtgataacaaattcgtgtcatctaaaaataagactcttaaaatccttatatatcaacaattataacttatccttaccctaaaatcacactcgattgtatcttaaaatagattaacaaattaagtgtcattttccctaaaaataacaaattagatgtcgccttcggaaaaggcgattttttttgtttttgagtggcaattcacagattaaatgtcatagaataataagtacacatcaactttgattttattaaacataaaaatatcagctatgactattgaaaatcaaatttctgaatctcaggaactgatttctcaactttctcccgaagaacaggc

SEQ ID NO: 990 - DNA, 500 bp, Geminocystis species
gcttttattttgaactaaaactctactaattagaatctgtcatcgagacgaaacaaaacgatcatattttctttttaaagttataatttcaatagtgccgtagatcaagttttaacaacctctgttctatgaaaaatgaggagtagtttactttttacaagaagtttgctttcggctcctgctaactacttgccctgatgctgtctatcttaggatagagaaactaggcgcactcccagcaataagggtgcaggtgtactgctatagcggttagcaaatcactttcgatcgaggaagaattctctttgagaattgaaagcgagtcctgtcgcacccaatcatttagacgacattaatctgttatcacgtcatctaatttgttaagacgacactaatctgttaccgatgacaaataatttgttactgtacatcaatttaaaatacgagccaacggctaagtaatacacgggtgcgacaggactcgaacctgtgaccgactg

SEQ ID NO: 991 - DNA, 1857 bp, Nostoc species
atgcccgacaaagagtttggactgaccggcgagctgacccagattaccgaggccatctttctgagcgagagcaacttcgtggtggaccctctgcacatcatcctggaaagcagcgacagccagaagctgaagttcaacctgatccagtggctggccgagtctcccaacagacagatcaagagccagcggaagcaggccgtggctgatacactgggagtgtccaccagacaggtggaacggctgctgaaagagtacaacggcgaccggctgaatgagacagctggcgtgcagagatgcgacaagggcaagcacagagtgtccgagtactggcagcagtacatcaagaccatctacgagaacagcctgaaagaaaagcaccctatgagccccgccagcgtcgtgcgggaagtgaaaagacacgccatcgtggatctgggcctcgagcacggcgattatcctcatcctgccaccgtgtaccggatcctgaatcctctgatcgagcagcagaagcggaagaagaagatcagaaaccccggcagcggcagctggctgaccgtggaaacaagagatggcaagcagctgaaggccgagttcagcaaccagatcatccagtgcgaccacaccgagctggacatcagaatcgtggacagcaacggcgtgctgctgcccgaaagaccttggctgacaaccgtggtggataccttcagcagctgcgtgctgggctttcacctgtggatcaagcagcctggaagcgccgaagttgccctggctctgagacacagcatcctgcctaagcagtaccctcacgactacgagctgagcaagccttggggctacggccctccattccagtactttttcaccgacggcggcaaggacttcagatccaagcacctgaaagccatcggcaagaaactgcggtttcagtgcgagctgcgggacagacctaatcaaggcggcatcgtggaacggatctttaagaccatcaacacccaggtgctgaaggacctgcctggctacacaggcagcaacgtgcaagagaggcctgagaacgccgagaaagaggcctgtctgggcatccaggacatcgacaagatcctggccagcttcttctgcgacatctacaaccacgagccgtatcctaaggaccccagagagacaagattcgagcggtggttcaaaggcatgggcggcaagctgcctgagcctctggatgagagagagctggatatctgcctgatgaaagaaacccagagagtggtgcaggcccacggcagcatccagttcgagaacctgatctacagaggcgagagcctgagagcctacaagggcgagtacgtgaccctgagatacgaccccgaccacatcctgacactgtacgtgtacagctgcgacgccaacgacgatatcggcgactttctgggctatgtgcacgccgtgaacatggacacccaagagctgtccatcgaggaactgaagtccctgaacaaagagcggagcaaggccagaagagagcacagcaattacgacgccctgctggccctgggcaagagaaaagagctggtcaaagagcgcaagcaagagaagaaagagcggcggcaggccgagcagaagagactgagaagcggcagcaagaaaaactccaacgtggtggaactgagaaagagccgggccaagaactacgtgaagaacgacgaccccatcgaggtgctgccagagagagtgtcccgggaagagatccaggtgccaaagaccgaggtgcagatcgaggtgtccgagcaggccgacaacctgaagcaagaaagacaccagctcgtgatcagcagacggaagcagaacctgaagaacatctggtga

SEQ ID NO: 992 - DNA, 855 bp, Nostoc species
atggcccagagccagctggtcatccagcctaacgtggaaacactggcccctcagctggaactgaacaatcagctggccaaggtggtggaaatcgaggaaatcttcagcaactgcttcatccccaccgaccgggcctgcgagtacttcagatggctggacgagctgcggatcctgaagcagtgtggcagagttgtgggccccagagatgtgggcaagagcagagcctctgtgcactacagagaagaggaccggaagaaagtgtcctacgtcagagcttggagcgccagcagcagcaagagactgttcagccagattctgaaggacatcaaccacgccgctcctaccggcaagagagaggatctcagacctagactggccggcagcctggaactgttcggaatcgagcaagtgatcgtggacaacgccgacaacctgcagagagaggcactgctggacctcaagcagctgttcgacgagagcaacgtgtccgtggtgctcgttggaggccaagagctggacaagatcctgcacgactgcgacctgctgaccagctttcccacactgtacgagttcgacaccctggaagatgacgacttcaagaaaaccctgagcaccatcgagttcgatgtgctggcactgccccaggcctctaatctgtgtgaaggcatcaccttcgagatcctggtgcagagcacaggcggcagaatcggcctgctggttaagatcctgaccaaggccgtgctgcacagcctgaagaatggcttcggcagagtggaccagaacatcctggaaaagatcgccaacagatacggcaagcggtacatccctcctgagaaccggaacaagaacagctga

SEQ ID NO: 993 - DNA, 555 bp, Nostoc species
atggaaaaggacacgttccctccaaagaccgagatcagaatccacgacaaccacgaggccctgcctagactgggctacgtggaaccttatgagggcgagagcatcagccactacctgggcagactgcggagattcaaggccaacagcctgcctagcggctacagcctgggaaagatcgccggaattggcgccgtgaccaccagatgggagaagctgtacttcaacccatttcctagcagcgaggaactggaagccctgggcaagctgattggcgtgccagccaaccggatctacgagatgttgcctcctaagggcgtgaccatgaagcccagacctatcagactgtgcgccgcctgttatgccgaggtgccctgtcacagaatcgagtggcagtacaaggacaagctgaagtgcaaccaccacaacctgggcctgctgaccaagtgcaccaactgcgagacaccctttcctatacctgccgactgggtgcagggcgagtgccctcactgttttctgccctttgccaagatggccaagcggcagaaaccccggtaa

SEQ ID NO: 994 - DNA, 1908 bp, Nostoc species
atgagcgtgatcaccatccagtgcagactggtggccgaagaggacaccctgagacaagtgtgggagctgatgaccgacaagaacacccctctggtcaacgagctgctggcccaagtgggaaagcaccccgagtttgagacatggctggaaaagggcaagatccccaccgagtttctgaaaaccctggtcaacagcctgaagaatcaagagcggttcagcgaccagcctggccggttttacacaagcgccattgctctggtggactacgtgtacaagagttggttcgccctgcagaagcggcggaagagacagatcgagggcaaagagcggtggctgatcatcctgaagtccgacctgcagctggaacaagagtcccagtgcagcctgaacgtgatcagaaccgaggccaacgagatcctggccaagttcacccctcagagcgaccagaacaagaaccagagaaagagcaagcggaccagaaagagcgccaagctgcagacccctagcctgttccagaacctgctgaacacctacgagcagacccaagagacactgaccagatgcgctatcgcctatctgctgaagaacaactgccagatcagcgagagagatgaggaccccgaggaattcaaccggaacagacggaagaaagagattgagatcgagcggctgaaggatcagctgcagagcagaatccccaagggcagagatctgaccggcgaggaatggctgaaaacactggaaatcgccaccaccaacgtgccccagaacgagaatgaagccaaggcctggcaagccgctctgctgagaaaacctgccgacgtgccatttcctgtggcctacgagagcaacgaggacatgacctggctgcagaacgataagggcagactgttcgtgcggttcaacggcctgggcaagctgaccttcgagatctactgcgacaagcggcatctgcactacttcaagcggtttctcgaggaccaagagctgaagcggaacagcaagaatcagcacagcagcagcctgttcacactgcggagcggaagaatcgcttggagcctgggagaagagaagggcgagccctggaaagtgaacaagctgcacctgtactgcaccctggacacccggatgtggaccatcgagggaacacagcaggtcgtgtccgagaaaaccaccaagatcaccgagactctgaaccaggccaagcggaaggacgtgctgaacgacaagcagcaggccttcgtgaccagacagcagagcacactggaccggatcaacaacccatttcctcggcctagcaagcccaactaccagggccagccttctatcctcgtgggcgtgtcctttggcctggaaaagcctgtgacactggccgtggtggacgtgatcaagaatgaggtgctggcctaccggaccgtgaaacagctgctgggcaagaactacaacctgctcaaccggcagcggcagcagcaacagagactgtctcacgagagacacaaggtgcagaagagaaacgcccctaacagcttcggcgagtctgagctgggccagtacgttgacagactgctggctgacgccatcattgccattgccaagacataccaggccggcagcatcgtgatccccaagctgagagacatgagagagcagatcagctccgagatccagagcagagccgagaagaagtgccccggctacaaagaggtgcagcagaagtacgccaaagaataccggatgagcgtgcacagatggggctacggcagactgatcgagagcatcaaaagccaggccgccaaggccggaatcttcaccgagattggcacccagcctatccggggctctcctcaagagaaggctagagatctggccgtgttcgcctaccaagagagacaggccgctctgatctga

SEQ ID NO: 995 - DNA, 506 bp, Nostoc species
ttcactaatctgaaccttgaaaatataatatttgtataacagcgccgcagttcatgctcttttgagccaatgtactgtgataaatctgggttagtttggcagttggaagactgttatgctttctgaccctggtagctgcccgcttctgatgctgccatctgtagacttctatagatgggataggtgcgctcccagcaataaggagtaaagcttttagctgtaaccgttatttataacggtgtggattaccacagtggtggctactgaatcacccccttcgtcgggggaaccctcccaaatatttttttggcgaatcgaagcggggtcaaaatccctggggacttgccaaactctgaaaacccttgtcctgtattgaatcaaagaatcattttgtaaattgatttactattttgattttcagcacaagcagctttttcagggacgtgtcaattagacatctgaaaagcttgtataacaagggcctagacgggaaaagtttcaacgat

SEQ ID NO: 996 - DNA, 37 bp, Nostoc species; identical to SEQ ID NO: 810

SEQ ID NO: 997 - DNA, 558 bp, Nostoc species
  misc_feature (535)..(558): n is a, c, g, or t
ttcactaatctgaaccttgaaaatataatatttgtataacagcgccgcagttcatgctcttttgagccaatgtactgtgataaatctgggttagtttggcagttggaagactgttatgctttctgaccctggtagctgcccgcttctgatgctgccatctgtagacttctatagatgggataggtgcgctcccagcaataaggagtaaagcttttagctgtaaccgttatttataacggtgtggattaccacagtggtggctactgaatcacccccttcgtcgggggaaccctcccaaatatttttttggcgaatcgaagcggggtcaaaatccctggggacttgccaaactctgaaaacccttgtcctgtattgaatcaaagaatcattttgtaaattgatttactattttgattttcagcacaagcagctttttcagggacgtgtcaattagacatctgaaaagcttgtataacaagggcctagacgggaaaagtttcaacgatgaaatcccggagtggggcgggttgaaagnnnnnnnnnnnnnnnnnnnnnnnn

SEQ ID NO: 998 - DNA, 500 bp, Nostoc species; identical to SEQ ID NO: 811

SEQ ID NO: 999 - DNA, 500 bp, Nostoc species; identical to SEQ ID NO: 812

SEQ ID NO: 1000 - DNA, 1962 bp, Calothrix species
atgtctgccctggacgtggacgacgacttcgagctggaagaggacacatacctgctgggcgacgaggacgccgacctgtttgatgatagcagcgacgtgatcctggtcaacgaggactacgacaccgccgaagaggataagagcgtggaattcctggaccagcggttcctggaagatagcgagctgagactgagcggcgagcagaggctgaagctggaaatcatcagaagcctgggcgagccctgcgacagaaagacatatggccagaagctgaaagaggccgcacagaagctgggcaagagcgagagaacagtgcggagactggtcaaggcctggcaagagaatggcctggccacctttgccgaaaccgccagagctgataagggccagaccagaaagagcgagtactggtacaacctgaccgtcaagacctacaaggcccggaacaagggcagcgaccggatgacaagaacacaggtggccgagaagatcgccatcagagcctatgagctggccaagaacgagctgaagcaagagatcagcaagctcgagacacagggcttcagaggcgaggaactggactggaaggtggacaccctgatcaagaccaaggccaagaccgagggcttcaactactggcagaagtacggcaaggccccttgcgccagaaccgtggaaagatggctgaagcccctggaagagaagaagcacaagagccggaccagcagatctcctggctggcacggatctgagcacgtgatcaaaacccgggacgaccaagagatctccatcaagtacagcaatcaagtgtggcagatcgaccacaccaaggccgatctgctgctggtggatgaggacggcgaggaaattggcagacctcagctgaccaccgtgatcgactgctacagcagatgcatcgtgggcctgagactgggctttgccgcaccatcttctcaggtggtggctctggccctgagaaacgccatcatgcccaagagatacggcagcgagtacgagctgaggtgcaagtggagtgcctacggcgtgcccagatacgtgtacacagatggcggcaaggacttccggtccaagcacctggtggaatggatcgccaacgagctggatttcgagcccatcctgagaagccagccttctgacggcggaatcgtggaaaggcccttcagaacaatgagcggcctgctgtctgagatgcctggctacacaggcagcagcgtgaaggatagacctgagggcgccgagaaaaaggcctgcatctctctgcctgagctggaaaagctgatcgtgggctacatcgtggacagctacaaccagaagccagacgccagatcacaggccaatcctttcacacccaagcagagccggatcgagagatgggagaagggcctgcagatgcctcctacactgctgaacgacagagagctggacatctgcctgatgaaggccgccgagagagtggtgtacgacaacggctacctgaacttcagcggcctgagatacaggggcgagaatctgggagcctacgccggcgagaaagtgatcctgagattcgaccccagagacatcacaatggtgctggtgtacggccggaccaacaacaaagagatctttctggccagggcctatgccgtgggactcgaagcagagaggctgagcatcgaggaagtgaagtacgcccggaagaaggccgagaatagcggcaagggcatcaacaatatcgccatcctcgaagaggctatccggcggagaaacttcctggacaagaagaaaaacaagaccaaagccgagcggaggcggagcgaggaaaagagagttgagcagatccctcaggtgctgaaggacaagaaacccgaacaggtggaaagcttcaacagccagcctgaggccgacgagtccatcgagaagctggatctgaagtccctgcgggaagaactgggcctgtaa

SEQ ID NO: 1001 - DNA, 807 bp, Calothrix species
atgaccaacgaggaaatccagcaagagatcgagcggctgagacagcccgacatcctgaacatcgagcaagtgaagagattcggcgcctggctggacgagcggagaaagctgagaaaacctggcagagccgtgggcgattctggcctgggaaaaacaaccgccagcctgttctacacctaccagaaccgggccgtgaagatccccaatcagaaccctgtggtgcccgtgctgtacgtggaactgacaggcagcagctgtagccccagcctgctgttcaagaccatcatcgagacactgaagttcaaggccaaaggcggcaacgagacacagctgagagagagagcctggtacttcatcaagcagtgcaaggtggaagtgctgatcatcgacgaggcccaccggctgcagtttaagacactggctgatgtgcgggacctgttcgacaaagtgaagatcgtgcctgtgctcgtgggcaccagcagcagactggataccctgatcagcaaggacgaacaggtggccggcagattcgccagctacttcagcttcgagaagctgtccggcgccaatttcatcaagatcctgaagatctgggagcagcagatcctgaggctgcccgagccttctaatctggccgacagccaagagatcatcaccatcctgcaagagaaaaccagcggccagatccggctgctggaccagattctgagagatgccgccgtgaaggccctggaatctggcgtgaacaagatcgacaagagcctgctggacagcatcgagggcgattatagcctcgtgggctcctga

SEQ ID NO: 1002 - DNA, 510 bp, Calothrix species
atgtgcaacgagatctacaacttcgaggcctggatcaacatcgtggaaccctttccaggcgagagcatcagccactttctgggcagattcgagcgggccaatctgctgacaggctaccagatcggaaaagaggccggcgttggagccatcgtgaccagatggaagaagctgtacctgaatccgtttccgacacagcaagagctggaagccctggccaacttcgtggaagtggccaccgagaagctgaaagaaatgctgcccgtgaagggcatgaccatgaagcccagacctatcaagctgtgcgccgcctgttatgccgagcagccctatcacagaatcgagtggcagtacaaggacaagctgaagtgcgaccggcacaacctgagactgctgaccaagtgcaccaactgtcagaccccttttcctattcctgccgactgggtggaaggcaagtgcagccactgcagcctgagatttgccaccatggccaagcggcagaaacccagataa

SEQ ID NO: 1003 - DNA, 2025 bp, Calothrix species
atgagcgtgatcaccatccagtgcagactgatcgcccacgtggccacactgagatacctgtggaagctgatggccgagaagaacacccctctgatcaacgagctgctggaacaggtggccgagcatcccaattttgaggcctggctgaagaaaggcgaggtgtccaagaccgccatcaagaccatctgcaacagcctgaaaacccaagagcggttcaacaaccagcctggccggttctacacaagcgccgtgacactggtgcacgaggtgtacaagtcttggtttgccctgcagcagcggcggcagagacagatcaacggcaaagaacggtggctgaacatgctgaagtccgacatcgagctgcagcaagagtcccagtgcgacctgaacgtgatcagagccaaggccaccgagatcctgaacaagttcaacgccaagttcagccagaagaagaagtacaagagcaagaagaaggccaacaacaccaagaacaagaacaaagagtttctgaacaacaccctgttcagcgccctgttcgatatgtacgacaagaccgaggactgcctgagcaagtgtgccctggcctacctgctgaagaacaactgcgaagtgaacgagctggacgaggaccaagagaagtacgccaaaaacaagcggcagaaagagatcgagatcgagcgcctgaagaagcagatcatcagcagaaagcccaaaggccgggacatcaccgccgagaagtggctgtctacactggaaaaggccaccaaccaggtgtcccagaacgaggatgaggccaaaagctggcaggccagcctgctgagaagagacagctgcatgccctatcctatcgactacgacagcgacgacctggaatggcgcgtgaactctctggccgaaaaaaacaacatcctcgagcagtctaagtacgacgtggacaacgaggcctacaaggatgtgaattggagcgacatcaaaaacaaagagggctacatcctggtcaagttcaatggcctcaaagagatcatcaagcaccccgagttctacgtgggctgcgacagcagacagctggactacttccagcggttctgccaggactggaagatctggaacgagaatcaagagacatacagctccggcctgttcctgctgcgctctgctagactgctgtggcaagagagaaaaggcaagggcgacccttggaccgtgcacagactgattctgcagtgcagcatcgagacacggctgtggacccaagaggaaaccgaactcgtccggctggaaaagatcgaccaggccgataagacaatcagcaacatggaaaagaaggacagcctcaacaagaaccaggtcgcctacctgaagaaaaccctgaccaccagacggaagctgaacaacccatttccaggcagaccctctcaggccctgtaccagggaaagtcctctatcctcgtgggcgtgtccctgggccttgataagcctgctacagtggccgtggtggatgccgcctctaagaaggtgctgacctacagaagcgtgaaacagctgctgggccagaagtataatctgctgaaccggcagcgccagcagcagcagagactgtctcacgagagacacaaagcccagaagcagaacgcccctaacagcgcctctgagtctgagctgggacagtacatcgacagactgctggccgatgccatcgtggccattgccaagacatactccgccagctccatcgtgctgcccaagctgcaagatctgcacgagatcatcgagagcgagatccaagtgaaggccgagaaaaaggtgcccggctacaaagaagggcagaagaactacgccaagcagtacagagtgaacatccacagatggtcctacggccggctgttcaagatcattcagtctcaggccgccaaggcctccatctccatcgagatcaccagcagcgtcatcagaagcagccctcaagagaaagccagagatctggccctgctggcctatcaagagagacaggccaagctgacctga

SEQ ID NO: 1004 - DNA, 517 bp, Calothrix species
ttgatgcaaaaattctgaaccttgacaatataataagaaaataatagcgccgcagttcatgctctttagaacggctctaaagagccgctgtactgtgaaaaatctgggttaggttgaccatagcgaagattggtcgatgctttctgaccctggtagctgcccgcttctgatgctgccatctgtagaattctatagatgggataggtgcgctcccagcaataagaagtaaggcttttagcaatagccgttgttcgcaacggtgcgggttaccgcagtggtggctactgaatcacccccttcgtcgggggaaccctccaaaatatttttttggcatgtcaaagcgggggcaaaatccctggagtcctgccagaatattaaaacccttatccagtcttagctagcaaaactagtgtgtcaatgcatttagttttttgatttttggtttgagactctattaagcagacctgccaaattatgtgtatggaaagcttttataggaagggttctagacgggtcg

SEQ ID NO: 1005 - DNA, 37 bp, Calothrix species; identical to SEQ ID NO: 819

SEQ ID NO: 1006 - DNA, 569 bp, Calothrix species
  misc_feature (546)..(569): n is a, c, g, or t
ttgatgcaaaaattctgaaccttgacaatataataagaaaataatagcgccgcagttcatgctctttagaacggctctaaagagccgctgtactgtgaaaaatctgggttaggttgaccatagcgaagattggtcgatgctttctgaccctggtagctgcccgcttctgatgctgccatctgtagaattctatagatgggataggtgcgctcccagcaataagaagtaaggcttttagcaatagccgttgttcgcaacggtgcgggttaccgcagtggtggctactgaatcacccccttcgtcgggggaaccctccaaaatatttttttggcatgtcaaagcgggggcaaaatccctggagtcctgccagaatattaaaacccttatccagtcttagctagcaaaactagtgtgtcaatgcatttagttttttgatttttggtttgagactctattaagcagacctgccaaattatgtgtatggaaagcttttataggaagggttctagacgggtcggaaatcccggctaggggtgggttgaaagnnnnnnnnnnnnnnnnnnnnnnnn

SEQ ID NO: 1007 - DNA, 500 bp, Calothrix species
aaaaagcattgagagaccctttcacaaaggcaatcatcctcgctcaataattacaattctcaacacttaagtccaacttgcctggagtaaagccatcaatctgtcaacgcggacaaataatttggcaatcgacactgtagagcgacaaattatttgaccacatcgacaaattatttgtcacattaatacattagtgaacaatccttatataccaatacttttcaccatttgatagctaagaaagctgtttaggttgtctgccacaaattatgtgtcatttttttagtaatccgacacattaagcgtcatttgttaatttggcgaaaaattagctgtcaattcttcacagctttatagtagtataaatgtacgttagtttttcacaaaaaaattacatctatgagcgctttagatgtagatgacgattttgaactggaagaagatacctacctattaggtgatgaagatgcagacctgttcgatgactcatcggatgtaat

SEQ ID NO: 1008 - DNA, 500 bp, Calothrix species
agttttaacaaccatcccaattagggctgggttgaaagcaaatttttgtcgttactatgtgaaatatttgtttgaattaggagggttgaaaggcgcacttcgttcgggataattccgacactgtgtatagtaaaatctatgcgacttcaattaggaaaatcatctctggaaagagattgacaaataatttgtcgttttggttttttgacaaataatatgtcgccacggacagataatttgtcgctttacaacaataatcgggatgactggattcgaaccagcggccccttcgtcccgaacgaagtgcgctaccaagctgcgctacatcccggcataataagcccattgtttaaatatgatatcattaataatggtaaatgtacacccatgctgatttttatttgggaaattgcgatcgcctgggtagaatagtcgaatcacctgaaagttctgattttcaaaacatggtgactaacagtaatcatcagtgagataatttt

SEQ ID NO: 1009 - DNA, 1683 bp, Calothrix species
atgctggacgagcacagcaacggcgatcaagagcccgagaacgacgagatcgtgacagagctgagcgccgacaaccggcatctgctggaaatgatccagcagctcctggaaccttgcgaccggatcacatacggcgagagacagagagaggtggccgccaagctgggaaagtctgtgcggacagttcggcggctggtcaagaagtgggaagaagaaggactggccgctctgcagacaaccgccagagccgataagggcaagcacagaatcgacaccgactggcagcagttcatcatcaagacctacaaagagggcaacaagggcagcaagcggatcacccctcagcaggttgccattagagtgcaggccagagctgccgagctgggccagaagaagtaccccagctaccggaccgtgtacagagtgctgcagcccatcatcgagcagcaagagcagaaggccggcgtcagatctagaggctggcacggctctagactgagcgtgaaaaccagagatggcaaggacctgagcgtggaatactccaaccacgtgtggcagtgcgaccacaccagagtggatctgctgctggtggatcagcacggcgaactgcttggtagaccttggctgaccaccgtggtggacacctactccagatgcatcatgggcatcaacctgggcttcgacgcccctagttctcaggttgtggccctggccgttagacacgccattctgcctaagcagtacggcagcgagtacggcctgcacgaggaatggggcacatatggcaagcccgagcacttctacaccgacggcggcaaggacttcagaagcaaccatctgcagcagattggcgtgcagctgggctttgtgtgccacctgagagacaggccatctgaaggcggcatcgtggaaagacccttcggaaccttcaacaccgatttcttcagcaccctgcctggctacaccggcagcaatgtgcaagaaagacctgagcaggccgagaaagaggcctgtctgaccctgagagagctggaacacagattcgtgcggtacatcgtggacaagtacaaccagcggcctgacgccagactgggcgatcagacaagatatcagagatgggaggccggactgatcgctagccccaacgtgatcagcgaggaagaactgcggatctgcctgatgaagcagacccggcggagcatctacagaggcggctatctgcagttcgagaacctgacctaccggggcgaaaatctggccggatatgctggcgagagcgtggtgctgagatacgaccccaaggacatcaccacactgctggtgtacagacacagcggcaacaaagaagagttcctggccagagccttcgctcaggacctggaaacagaacagctgagcctggatgaggccaaggccagctccagaaagattagacaggccggcaagatgatcagcaaccggtccatgctggccgaagtgcgggacagagaaaccttcgtgacccagaaaaagaccaagaaagagcggcagaaagccgaacaggccgtggtcgagaaggccaagaaacccgttcctctggaaccagagaaagaaatcgaggtggccagcgtggacagcgagagcaagtatcagatgcccgaggtgttcgactacgaggaaatgcgggaagagtacggctggtga

SEQ ID NO: 1010 - DNA, 837 bp, Calothrix species
atgacaagcaagcaggcccaggccattgctcagcagctgggagacatccccgtgaacgatgagaagctgcaggccgagatccagcggctgaacagaaagagcttcatccctctggaacaagtgaagatgctgcacgactggctggacggcaagagacagagcagacagtctggcagagtgctgggcgagagcagaaccggcaagaccatgggctgtgacgcctacagactgcggcacaagcctaagcaagagcccggcaaacctcctacagtgcccgtggcctacatccagattcctcaagagtgcagcgccaaagagctgttcgccgccatcatcgagcacctgaagtaccagatgaccaagggcaccgtggccgagattcgggaaagaaccctgagagtgctgaaaggctgcggcgtggaaatgctgatcatcgacgaggccgaccggttcaagcccaagacctttgctgaagtgcgggacatcttcgacaagctggaaatcgccgtgatcctcgtgggcaccgatagactggatgccgtgatcaagcgggacgaacaggtgtacaaccggttcagaagctgccacagattcggcaagttcagcggcgaggacttccagcggacagtggaaatctgggagaaacaggtgctgaagctgcctgtggccagcaacctgagcagcaagacaatgctgaaaaccctgggcgaaaccaccggcggctatatcggactgctggacatgatcctgagagagagcgccattcgggccctgaagaaaggcctggccaagatcgacctggaaaccctgaaagaagtggccgccgagtacaagtga

SEQ ID NO: 1011 - DNA, 510 bp, Calothrix species
atggaagtgcccgagatccagagctggctgttccaggtggaacctctggaaggcgagagcctgtctcacttcctgggcagattcagacggaccaacgatctgacagccaccggcctgggaaaagccgctggacttggcggagtgattgccagatgggagaagttccggttcaaccctccacctagccggcagcaactggaagccctggctaaagttgtgggcgtgaacgccgatagactggcccaaatgcttcctcctgctggcgtgggcatgaagatggaacccatcagactgtgcgccgcctgctacgtggaaagcccttgtcacaagatcgagtggcagctgaaagtgacccagggctgcgccagacacaatctgtctctgctgagcgagtgccccaattgcggcgccagattcaaagtgcctgctgtgtgggtggacggctggtgccagagatgctttctgaccttcgccgacatggtcaagcaccagaagtccatcgactactga

SEQ ID NO: 1012 - DNA, 1938 bp, Calothrix species
atgagccagatcaccatccagtgcagactggtggccagcgagagcacaagacagcagctgtggaagctgatggccgagctgaacacccctctgatcaacgagctgctgcggcaagtgcaccagcatcctgagtttgagacatggcggcagaagggcaagcaccccacctccattgtgaaagagctgtgccagcctctgaaaacagaccccagcttcatcggccagccaggcagattctacaccagcgccattgccaccgtgaactacatctacaagagctggttcaagctgatgaagcggagccagagccagctggaaggcaagattcgttggtgggagatgctgaagtccgacgccgagctggtggaagtgtctggcgtgacactggaaagcctgagaagcaaggccgacgagattctggcccacttcacccctcagagcgacaccgttgaagcccagcctggaaagggcaacaagcggaaaaagaccaagaaaagcaaggtggccgagggcgactgtgccgagagaacactgagagagcggagcatcagcaagaccctgttcgaggcctacagagacaccgaggacatcctgacacactgcgccatctcttacctgctgaagaacggctgcaagatcaacgacaaagaagaggacacccagaagttcgccaagcggcggagaaagctggaaatccagatcgagcggctgcgcgaacagctcgaggccagaattcctaagggccgcgatctgaccaacggcaagtggctggaaacactgctgctggccacacacaatgtgcccgagtctgagacagaggccaagtcctggcaggacagcctcctgaagaaaagctccaaggtgccatttcctatcgcctacgagacaaacgaggatatgacctggtttaagaacgagcggggcagaatctgcgtgaagttcaacggcctgagcgagcacagcttccaggtgtactgcgacagcagacagctgcactggttccagcggtttctggaagatcagcagatcaagcagaacagcaagaaccagcacagcagcagcctgttcaccctgagatctggcaggatcgcctggcaagaaggcgaaggcaaaggcgaggaatggaaagtgaaccacctgatcttctactgcagcgtggacaccagactgtggaccgccgagggaacaaatctcgtgcgcgtggaaaaggccgaggaaatcgccaagaccatcacacagaccaaggccaagggcgagctgaatgatcagcagctggcccacatcaagcggaagaactcttctctggcccggatcaacaacagcttccccagacctagcaagcccctgtaccagggccagtctcatatcctggtggccgtgtctctgggactcgagaaacctgctacagtggccgtggtggatggcaccatcggaaaggtgctgacctaccggtctatcaggcagctgctgggcgacaactacaagctgctgaaccggcagagacagcagaagcacacactgagccaccagagacagatcgcccagatgctggccgctcctaatgagctgggagagtctgaactgggcgagtacatcgagagactgctcgccaaagagatcattgccattgctcagacctacaaggccggctccatcgtgctgcccaaactgggagacatgagagaacaggtgcagagcgagatccaggccaaggccgaacagaagtccgatctgatcgaggtgcagcagaagtatgccaagcagtaccgggtgtccacacaccagtggtcctacggcagactgatcgagaacatcagaagcagcgccgccaagacaggcatcgtgatcgaggaaagcaagcagcccatccggggaagccctcaagagaaggccaaagagctggctatcgccgcctaccacagccggcagaaaacatga

SEQ ID NO: 1013 - DNA, 458 bp, Calothrix species
ttgacaaaacaccgaaccttgaaaatagaataagtatcattaatagcgtcgcagttcatgcttgtataaagccgctgtgctgtgtaaatgtgggttagtttgactgctgttaaacagtcttgctttctgaccctggtagctgcccaccttgatgctgctatcccttgtggataggaataaggtgcgcccccagtaatagaggtgcgggtttaccgcagtggtggctactgaatcacctccgaccaaggaggaacccaccttaattattttttggcgaatcgaagcgggtcaatttccctggggatctgccaaaacttcaaatcgcttattgattaaggcttgtagcttttatggtgtcagttaatttacttttttaagtgttaagtgacaggcgattttggcagatctgacaaaaatgcttctagaagtctttattggtgaaggatttgaggcgctgg

SEQ ID NO: 1014 - DNA, 37 bp, Calothrix species
gtttcaatacccctcacagcttgaggcgggttgaaag

SEQ ID NO: 1015 - DNA, 510 bp, Calothrix species
  misc_feature (487)..(510): n is a, c, g, or t
ttgacaaaacaccgaaccttgaaaatagaataagtatcattaatagcgtcgcagttcatgcttgtataaagccgctgtgctgtgtaaatgtgggttagtttgactgctgttaaacagtcttgctttctgaccctggtagctgcccaccttgatgctgctatcccttgtggataggaataaggtgcgcccccagtaatagaggtgcgggtttaccgcagtggtggctactgaatcacctccgaccaaggaggaacccaccttaattattttttggcgaatcgaagcgggtcaatttccctggggatctgccaaaacttcaaatcgcttattgattaaggcttgtagcttttatggtgtcagttaatttacttttttaagtgttaagtgacaggcgattttggcagatctgacaaaaatgcttctagaagtctttattggtgaaggatttgaggcgctgggaaatcacagcttgaggcgggttgaaagnnnnnnnnnnnnnnnnnnnnnnnn

SEQ ID NO: 1016 - DNA, 500 bp, Calothrix species
cattgagagaccctttcacaaaggcaatcatcctcgctcaataattacaattctcaacacttaagtccaacttgcctggagtaaagccatcaatctgtcaacgcggacaaataatttggcaatcgacactgtagagcgacaaattatttgaccacatcgacaaattatttgtcacattaatacattagtgaacaatccttatataccaatacttttcaccatttgatagctaagaaagctgtttaggttgtctgccacaaattatgtgtcatttttttagtaatccgacacattaagcgtcatttgttaatttggcgaaaaattagctgtcaattcttcacagctttatagtagtataaatgtacgttagtttttcacaaaaaaattacatctatgagcgctttagatgtagatgacgattttgaactggaagaagatacctacctattaggtgatgaagatgcagacctgttcgatgactcatcggatgtaatacttgt

SEQ ID NO: 1017 - DNA, 500 bp, Calothrix species; identical to SEQ ID NO: 1008

SEQ ID NO: 1018 - DNA, 1740 bp, Scytonema species
atgggcgagacactgaacagcaacgaggtggacgagagcctggtgctgtacgatggctctgacgaagtggatgagatcagcgagagcgaggacaccaagcagagcaacgtgatcgtgaccgagctgagcgaagaggccaagctgagaatgcaggtcctgcagagcctgatcgagccctgcgacagaaagacctacggcatcaagctgaagcaggccgccgagaagctgggaaagaccgtcagaacagtgcagcggctggtcaagaagtaccaagagcagggactgagcggcgtgacagaggtggaaagatctgacaaaggcggctaccggatcgacgacgactggcaggacttcatcgtgaaaacctacaaagagggcaacaaaggcggacggaagatgacccctgctcaggtggccatcagagtgcaagttcgcgctggacagctgggcctcgagaagtacccttgtcacatgaccgtgtaccgggtgctgaaccccatcatcgagcggaaagaacagaaacagaaagtgcggaacatcggctggcggggcagcagagtttctcaccagacaagagatggccagacactggacgtgcaccacagcaatcacgtgtggcagtgcgaccacaccaagctggatgtgatgctggtggaccagtacggcgaaaccctggctagaccttggctgaccaagatcaccgacagctacagccggtgcatcatgggcatccacctgggctttgatgcccctagctctctggtggtggccctggctatgagacacgccatgctgaggaagcagtacagcagcgagtacaagctgcactgcgagtggggcacatatggcgtgcccgagaacctgtttaccgacggcggcaaggacttcagaagcgagcacctgaagcagatcggcttccagctgggattcgagtgtcacctgagagacagacctccagaaggcggcatcgaggaaagaggcttcggaacaatcaataccagcttcctgagcggcttctacggctacctggacagcaacgtgcagaagaggcctgagggcgccgaagaggaagcctgtatcacactgagagagctgcatctgctgatcgtgcggtacatcgtggacaactacaaccagagaatcgacgccagaagcggcaaccagaccagattccagagatgggaagccggccttcctgctctgcccaacctggtcaatgagcgcgagctggacatctgcctgatgaagaaaacccggcggagcatctacaaaggcggatacgtgtccttcgagaacatcatgtaccggggcgactacctgtctgcctatgccggcgaatctgtgctgctgagatacgaccccagagacatcagcaccgtgttcgtgtacagacaggacagcggcaaagaggtcctgctgtctcaggcccacgccatcgatctggaaaccgagcagatcagcctggaagagacaaaggccgccagcagaaagatccggaatgccggcaagcagctgagcaacaagtctatcctggccgaggtgcaggaccgggacacctttatcaagcagaagaagaagtcccacaagcagcggaagaaagaggaacaggcccaggtccacagcgtgaagtctttccagaccaaagaacccgtggaaaccgtggaagagatccctcagcctcagaaaagacggcccagagtgttcgactacgagcagctgcggaaggactacgacgattga

SEQ ID NO: 1019 - DNA, 837 bp, Scytonema species
atggccgaggactacctgagaaaatgggtgcagaacctgtggggcgacgaccccattcctgaagaactgctgcccatcatcgagcggctgatcacacctagcgtggtggaactggaacacatccagaagatccacgactggctggacagcctgagactgagcaagcagtgcggcagaattgtggcccctcctagagccggcaagagcgtgacatgtgacgtgtacaagctgctgaacaagccccagaagagaaccggcaagcgggacattgtgcccgtgctgtatatgcaggctcccggcgattgctctgctggcgaactgctgacactgatcctggaaagcctgaagtacgacgccaccagcggcaagctgaccgacctgagaagaagagtgctgcggctgctgaaagaaagcagagtggaaatgctcgtgatcgacgaggccaacttcctgaagctgaacaccttcagcgagatcgcccggatctacgacctgctgaagatcagcatcgtgctcgtgggcaccgacggcctggacaacctgattaagaaagagcggtacatccacgaccggttcatcgagtgctataagctgcccctggtgtccgagaacaagttccccgagttcgtgcagatctgggaagatgaggtgctgtgcctgcctgtgcctagcaatctgatcaagagcgagacactgaagcccctgtaccagaaaacctccggcaagatcggcctggtggacagagttctgagaagggccgccatcctgagcctgagaaagggcctgaagaatatcgacaaggccacactggacgaggtgctcgagtggttcgaatga

SEQ ID NO: 1020 - DNA, 528 bp, Scytonema species
atggaaatccctgccgagcagcccagattcttccaggtggaacctctggaaggcgagagcctgtctcacttcctgggcagattcagaagagagaactacctgaccgccacacagctgggcaagctgacaggcattggagccgtgatcagcagatgggagaagttctacctgaatccgtttccgacacctcaagagctggaagccctggccgctgtggtggaagtgaaagtggaccggctgatcgagatgctgcctcctaagggcgtgaccatgaagcccagacctatcagactgtgcggcgcctgctaccaagagtccccttgtcacagagtggaatggcagttcaaggacaagctgaagtgcgtgtccgaggctcaccccaaggatgccagacatcaactgggcctgctgacaaagtgcaccaactgcgagacaccctttcctatacctgccgactgggtgcagggcgagtgccctcactgttttctgcccttcgccaagatggccagacggcagaagagatactga

SEQ ID NO: 1021 - DNA, 2073 bp, Scytonema species
atgagcgtgatcaccatccagtgcagactggtggccgaggaaaacaccctgagacagctgtgggagctgatggccgagaagaacacacccctgatcaacgagctgctggaacaagtgggacagcaccccaacttcgagaagtggctgaagaaaggcgaggtgcccgaggaagccatcgacaccatcaagaagtccctgatcacccaagagcctttcgccggccagcctggcagattctacacatctgccgtgacactggtcaaagagatctacaagagttggttcgccctgcagcaagagcggcagagaaagatcgagggcaaagaacggtggctgaaaatgctgaagtccgacatcgaactccagcaagagtcccagtgcaacctggacatcatccggaacaaggccaacgagatcctgaccagcttcgtggccaacttcaccgagaaccggaaccagcagttcaagaagaagggcaacaagaccaagaagaacaagaaagaggaagaagagagcaccctgttcaacgccctgtttaagatctacgataagaccaaggactgcctgagccagtgcgccctggcctatctgctgaagaacaactgccaggtgtccgagatcgacgaggaccccgaggaatacgtgaagcgcagacggcggaaagagatcgagatcgagcgcctgcggaagcagctgaagtctagaaagcccaagggcagagatctgaccggcgaaaaatggctgacagccctgaaagaggccaccaatcaggtccccgtggatcagctggaagccaagtcttggcaggcttccctgctgaaagtgaccagcgacatcccctatcctgtggactacgagagcaacaccgacctggactggctgattcacagcaacgacgacgacatcaagaaaaaagtgatcctcgtgtggcagatctacttcctgaaacagctgatcaagtccggcagctacagcttcatcaagtacctgtacttccagcggggctgcctgcctaagagagatgtgaactggctgaacctcaagaacaaagccggcaggatcttcgtgaagttcaacggcctgaggaagaacatcatcaaccccgagttctacatctgctgcgacagccggcagcggcactacttccagagactgtgccaggactggcaagtgtggcacgacaacgaggaaacctacagcagcagcctgttctttctgcggagcgccagactgctgtggcagaagagaaaaggcacaggcgccccttggaaagtgaaccggctgatcctgcagtgcagcatcgagacaagactgtggaccgaagaggaaaccgaactcgtccggatcgagaagatcaaccaggccgagacagagatcagagagagcgagcagaaaggcaagcccaagcagaaggtgctgagccacagacagaagctgaacaatctgttccccaacagacccagcaagcccatctacaagggcaagcctaacatcatcgtgggcgtgtccttcggcctggataagcctgctacagtggccgtggtggatgtggccaacaaaaaggtgctggcctaccggtccaccaaacagctgctgggcaagaactacaacctgctgaaccggcagagacagcaacagcagaggctgtctcacgagagacacaaggcccagaagcggaacgcccctaatagctttggcgagtctgagctgggccagtacgtggacagactgctcgccgatgccatcattgccattgccaagacataccaggccggcagcatcgtgatccccaagctgagagacatgagagagcagatcaccagcgagatccagagcagagccgagaaaaagtgccccggctacaaagaggcccagcagaagtacgccaaagaataccggctgagcgtgcacagatggtcctacggcagactgatcgagagcatcaagagccaggccgccaaagtgggcatcagcacagagatcggcacccagcctatcagaggcagccctgaggaaaaggctagagatctggccgtgttcgcctaccaagaaagacaggccgctctggtgtaa

SEQ ID NO: 1022 - DNA, 497 bp, Scytonema species
ttcactaatctgaaccttgaaaatataatattgttataacagcgccgcagttcatgctctttcgagcctctgtactgtgaaaaatctgggttagtttggcagttgtcagactgtcatgctttctgaccctggtagctgcccgcttctgatgctgccatctgtagaattctatagatgggataggtgcgctcccagcaataaggagtaaggcttttagccatagtcgttattcataacggtgtggattaccacagtggtggctactgaatcacccccttcgtcgggggaaccctcccaaatattttttttggcaaagcgaagcgggggcgaaatccctggagtccttgccaaaatcttaaaacccttgttctatattagtttcataaactaaggtgtcaattgatttagttttttcaaattagattgaagaagctttttagcagcattgtcaaatttgtatgcgaaaagcttcagtaacaagggtctagacgggcaga

SEQ ID NO: 1023 - DNA, 37 bp, Scytonema species; identical to SEQ ID NO: 819

SEQ ID NO: 1024 - DNA, 549 bp, Scytonema species
  misc_feature (526)..(549): n is a, c, g, or t
ttcactaatctgaaccttgaaaatataatattgttataacagcgccgcagttcatgctctttcgagcctctgtactgtgaaaaatctgggttagtttggcagttgtcagactgtcatgctttctgaccctggtagctgcccgcttctgatgctgccatctgtagaattctatagatgggataggtgcgctcccagcaataaggagtaaggcttttagccatagtcgttattcataacggtgtggattaccacagtggtggctactgaatcacccccttcgtcgggggaaccctcccaaatattttttttggcaaagcgaagcgggggcgaaatccctggagtccttgccaaaatcttaaaacccttgttctatattagtttcataaactaaggtgtcaattgatttagttttttcaaattagattgaagaagctttttagcagcattgtcaaatttgtatgcgaaaagcttcagtaacaagggtctagacgggcagagaaatcccggctaggggtgggttgaaagnnnnnnnnnnnnnnnnnnnnnnnn

SEQ ID NO: 1025 - DNA, 600 bp, Scytonema species
ttaatataataattattcaaatcaataaacacatcacagccttctaacttcaaaaacttccaaatatcccccgttgttactgcaccataaatagttgtcgaataactaattaaatgtcgtcttaacaaattaatgtcgctcaaaacgtaaaggctataatcgttactaagcaaggattatagcctttttgatttctatttagcattcctaaatatttaactaattaaacgtcgtaatttgtaaatataacaaaataagtgtcgttttttcaaaaaatctctttccaaagtttttaacggctcataacaaaataagtgtcgtcttttggaagtgagtaaaaaatctaaaattacgtgtcgctttttggaataaagtagtagtatatttactaggtaatagtaattatgtacgaataaggtgttacgcatttaatttttttgcccaaaagccttgcagcaaggactttaggctgcaaaatattacatttagatgcgcgtcagcttacaaacatagttgtactcaagtcttcttatttctctctacttgcaaagtcattcctcatattgcgttaaaggttgatgtgagttgaggctgtatact

SEQ ID NO: 1026 - DNA, 607 bp, Scytonema species
ggttcaacgaccatcccggctaggggtgggtttaaacgacgggaagagcaaatctgttactgctgtatgcagcaaggtttcaacaactatcccgggtcaagtttgcttgtgagggttgaaaggaatgtcaccttcccaatactagaagagtgtcaaaagctatgctggctaatggaaggttgaaattaatcgctatttttttgcaaagaaaagattctaccagttataaaaaagcaagagtgacaaacaattagtcgttcaaacaaatgacaaattgtttgtcgctctaaagtatcctagattacttgactatacgagtttattttttagggattaagctcggggaaaagtttgtgatctactgacattcaagtaacactgacaaataatttgtcactgtacaatactcaataagagtcggctacattaaatgactataagacaaataatttgtcgctttaccacttttgacaaataatttgtcgccacggtcaaataatttgtcgctctacatttgaaagcgggcgatgggactcgaacccacgacgttcaccttgggaaggtgacattctaccactgaattacacccgcaaatggatgttagcct

SEQ ID NO: 1027 - DNA, 1617 bp, Trichormus variabilis
atggtcatccagacactgctggaaccctgcgacagaaccacctacggccagaagctgaaagaggccgccgatacactgggagtgacagtgcgaacagtgcagcggctggtcaagaagtgggaagaggacggactcgtgggctttatccagaccggcagagccgataagggcaagcacagaatcggcgagttctgggagaacttcatcatcaagacctacaaagagggcaacaagggcagcaagcggatgacccctaaacaggtggcactgagagtgcaggccaaggccagagagctgggcgatagcaagcctcctaactaccggaccgtgctgagagttctggcccctatcctggaacagaaagaaaagaccaagagcatcagaagccccggctggcggggaacaacactgagcgtgaaaaccagagaaggccaggacctgagcgtggactacagcaatcacgtgtggcagtgcgaccacaccagagtggatgtgctgctggtggatcagcacggcgagctgctttctagaccttggctgaccaccgtgatcgacacctacagcagatgcatcatgggcatcaacctgggcttcgacgccccttcttctgtggtggttgctctggccctgagacacgccatcctgcctaagaaatacggcgccgagtacaagctgcactgcgagtggggcacatacggcaagcctgagcacttctacaccgacggcggcaaggacttcagatccaaccacctgtctcagatcggcgctcagctgggctttgtgtgtcacctgagagacagacctagcgaaggcggcatcgtggaaagacccttcaagaccctgaacgaccagctgttcagcaccctgcctggctacacaggcagcaacgtgcaagagcggctggaagatgccgagaaggatgccaagctgaccctgagagaactggaacagctgcttgtgcggtacatcgtggaccggtacaaccagagcatcgacgccagaatgggcgatcagaccagattcggaagatgggaggccggactgccttctgtgcctgtgcctatcgaggaacgcgacctggacatctgcctgatgaagcagagccgcagaaccgttcagagaggcggctgtctgcagttccagaacgtgatgtaccggggcgagtacctggctggatatgccggcgagacagtgaacctgagatacgaccccagagacatcaccaccgtgctggtgtaccggcaagagaagtcccaagaggtgttcctgaccagaacacacgcccagggactcgagacagaacagctgagcctggatgaagccgaggctgcctctcggagactgagaaatgccggcaagaccgtgtccaatcaggccctgctgcaagaagtgctggaacgggacgctatggtggccaacaagaagtcccggaaagagcggcagaagctcgagcaggccattctgagatctgccgccgtgaacgagagcaagacagagtctctggccagcagcgtgatggaagccgaagaggtggaaagcaccaccgaggtgcagagcagctctagcgaactggaagtgtgggactacgagcagctgcgggaagagtacggcttctga

SEQ ID NO: 1028 - DNA, 831 bp, Trichormus variabilis
atgaccgacgccaaggccattgctcagcagctcggcggagtgaagcctgacgaagaatggctgcaggccgagatcgccagactgaagggcaagtctatcgtgcccctgcagcaagtgcggagcctgcatgattggctggacggcaagagaaaggcccggcagttctgtagagtcgtgggcgagtctagaaccggcaagaccgtggcctgtgacgcctacagataccggcagaaagtgcaggctgaagtgggcagacctccaatcgtgcccgtggtgtatatccagcctcctcagaagtgcggcgccaaggacctgttccaagagatcatcgagtacctgaagttcaaggccaccaagggcaccgtgtccgacttcagaggcagaaccatggaagtgctgaaaggctgcggcgtggaaatgatcatcgtggacgaggccgatagactgaagcccgagacatttgccgaagtgcgggacatctacgacaagctgggaatcgccgtggtgctcgtgggaaccgacagactggaagccgtgatcaagcgggacgaacaggtgtacaaccggttcagagcctgccacagattcggcaagctgagcggcaaggacttccaggatacagtgcaggcctgggaagataagatcctgaagctgcccctgcctagcaacctgatcagcaaggacatgctgcggatcctgaccagcgccacagagggctatatcggcagactggacgagatcctgagagaggccgccatcagaagcctgtccagaggcctgaagaaaatcgacaagcccgtgctgcaagaggtggcccaagagtacaagtga

SEQ ID NO: 1029 - DNA, 504 bp, Trichormus variabilis
atggctgcccctgatgtgaagccctggctgttcatcatccagccttacgagggcgagagcctgagccacttcctgggcagattcagaagggccaatcacctgtctgccagcggcctgggaaaactggctggaattggagccgtggtggccagatgggagagattccacttcaaccccagacctagccagaaagagctggaagccattgccagcctggtggaagtggacgccgatagactggctcagatgctgcctccactcggcgtgggaatgcagcacgagcctattagactgtgcggcgcctgttatgccgaggctccttgtcacagaatcgagtggcagtacaagagcgtgtggaagtgcgaccggcacgagctgaagatcctggccaagtgtcccaattgcgaggcccctttcaagatccccgctctgtgggaagataagtgctgccacagatgcagaacccctttcgccgagatgaccaagtaccagaagatcacctga

SEQ ID NO: 1030 - DNA, 1920 bp, Trichormus variabilis
atgagccagaaaaccatccagtgccggctgatcgccagcgagagcaccagacagaaactgtggaagctgatggccgagagcaacacccctctgatcaacgagctgctccagcagctgagcaagcaccccgattttgagaagtggcggcggaacggcaagctgccttctacagtggtgtcccagctgtgccagcctctgaaaacagaccccagctttaccggccagcctagccggttttacatcagcgccatccacatcgtggactacatctacaagagctggctgaccatccagaagcggctgcagcaacagctggatggcaagctgagatggatcgagatgttcaacagcgacgtggaactggtggaaatcagcggcttcagcctggaagccatcaggacaaaggcctccgagatcctggccatcaccacacctgagagcgaccccaagacactgctgaccaagagaggcaagaccaagcagtccaagaagtccagcgccagcaatcccgacagaagcctgagcagaaagctgttcgacgcctaccaagagacagacgacatcctgtccagatccgccatctcctacctgctgaagaacggctgcaagctgaacgacaaagaggaaaaccccgagaagttcgccaagcggcggagaaaggtggaaattcagatccagcggctgaccgacaagctgaccagcagaatccccaaaggccgggacctgacctacagcaagtggctggaaaccctgttcaccgccaccaccacagtgcccgagaacaatgccgaggccaagagatggcaggacatcctgctgacaagaagcagcagcatcccatttccagtggtgttcgagacaaacgaggacctcgtgtggtccaccaacgagaagggcagactgtgcgtgcacttcaacggcctgagcgacctgatcttcgaggtgtactgcgacagcagacagctgtactggttcaagcggttcctggaagatcagcagaccaagcgcaagagcaagaaccagcacagcagcggcctgtttaccctgagaaatggcagactggcctggcagcaaggcgaaggcaaaggcgagccttggaacatcggacatctggccctgtactgctgcgtggacaacagactgtggacagccgagggcacagagcaagtgcggcaagagaaggccgaggaaatcaccaagttcatcaccaagatgaaggacaagtccgacctgagcgagacacagctggccttcatcaagcggaaagagagcaccctgaccaggatcaacaacagcttcgacagacccagcaagcccctgtaccagggccagtctcatatcctcgtgggagtgtctctgggcctcgagaagcctgccacaattgccgtggtggatgctatcgccggcaaggtgctgacctatcggagtctgagacagctgctcggcgacaactatgagctgctgaacagacagcggaggcagcagagatccctgagccacgaaagacacaaggcccagaagtctttcagccccaaccagtttggcgcctctgagctgggccagtacgttgacagactgctggccaaagaaatcgtggctatcgcccagacctacaaggccggctctatcgtgctgcctaagctgggcgacatccgcgagattgtgcagagcgagattcaggccattgccgaggctaagtgccctagcagctctgagatccagcagaagtatgccaagcagtaccgcgtgaacgtgcaccagtggtcctacggcagactgatccagagcatccagtccaaggccgctcagatcggcatcgtgatcgaggaaggcaagcagcccatcagaggcagccctcaggataaggctaaagaactggctctgtacgcctacagcctgcggctggccagaagatcttaa

SEQ ID NO: 1031 - DNA, 447 bp, Trichormus variabilis
caaacatctgaaccttgaaaatataatatgtaatagcgccgcagttcatgctgcttgcagcctctgaattgtgttaaatgagggttagtttgactgtagcaatacagtcttgctttctgaccctggtagctgctcaccctgatgctgctgccaatagacaggataggtgcgctcccagcaataagggcgcggatgtactgctgtagtggctacccaatcacccccgatcaagggggaaccctccccaattcttgatttgacgcaccaaagagaggtcaaaattccgatctaggttcgcgcacatcctgaaaaccttatcctacaaggaatttatgagtaaatttcttttgtagacaattcaaaaattacatcctgggaggctatttgatgaggttcgcgcaaatctgcttcaaaaaccttgctagacaagcgtttcatagagtggca

SEQ ID NO: 1032 - DNA, 37 bp, Trichormus variabilis
gttgcaaccctccttccagtaatgggagggttgaaag

SEQ ID NO: 1033 - DNA, 499 bp, Trichormus variabilis
  misc_feature (476)..(499): n is a, c, g, or t
caaacatctgaaccttgaaaatataatatgtaatagcgccgcagttcatgctgcttgcagcctctgaattgtgttaaatgagggttagtttgactgtagcaatacagtcttgctttctgaccctggtagctgctcaccctgatgctgctgccaatagacaggataggtgcgctcccagcaataagggcgcggatgtactgctgtagtggctacccaatcacccccgatcaagggggaaccctccccaattcttgatttgacgcaccaaagagaggtcaaaattccgatctaggttcgcgcacatcctgaaaaccttatcctacaaggaatttatgagtaaatttcttttgtagacaattcaaaaattacatcctgggaggctatttgatgaggttcgcgcaaatctgcttcaaaaaccttgctagacaagcgtttcatagagtggcagaaattccagtaatgggagggttgaaagnnnnnnnnnnnnnnnnnnnnnnnn

SEQ ID NO: 1034 - DNA, 500 bp, Trichormus variabilis
ctggcattcttactaatgcagcaaacctcactcagcctgaccaagttgcctctttgtgcgcttggtttattcaactttgatgtacagtgactaattatttgtcactgtacacaagatgtacagtgactaattatttgtcactgtacacaagatgtacagtgactaattgtttgtcgtcgtgacaaattaatgtcgtcgaatgaatccttgcaatacaaaggttttagctatttaagagttattacattatttctcatacgtgactaaataaatgtcgttttccgcaaaaatgacaaattaactgtcgcttcagtaattacaaaaaaggttttgtatattttcataatgacaaattgactgtcgttttctccacgtttagaataacattatgtatttataaattacctttgtttcatgaacaaaaaatcttatgtctgattttactgttcataccgcagtggatactgcggaagctttattacaagacaacaacacacctc

SEQ ID NO: 1035 - DNA, 500 bp, Trichormus variabilis
gttgcaaccctccttccggtaatacatggtgaaaacaaattggatatgaaactgccttacgttgtctgatggtgtaattaatttccaagaagtagagggttgaaagcaaatcccgtcatcggcttgtaactaaagttattcaggataagctactcatagaagtgattaaaagagctttttgaatgcaaacgcttataataggggctaaatatatagagaaactccatatataaattgttgcttttccgaaaaatgacaataatttgtcacaaatatatatggaagcgagttactaagttggatgacaataatttgtcacaacgacatcaatttgtcaccgacgacaaataagagaccatttataaagtaaatctttagacgactagacgacgtagcataatacgagtcataacggcatatatggcagcctcactcatttctgggagacgctcataatccttactgagacgacggtactggtttaaccagccaaatgttct

SEQ ID NO: 1036 - DNA, 1689 bp, Calothrix parasitica
atgggcgaagattaccccagcgacagcctggaaagcgagacaaacgagatcgtgaccgagctgagctacgaggaacgcagagtgctggaagtgatccagggcctgctggaaccctgcgacagaaagacatacggcgagaagcagagacaggccgctgccaagctgggaaagtctgtgcggaccatcagacggctggtcaagaagtgggaagaacagggacttgccgctctgcagaccaccaccagagtggataagggcagacaccggatcgacaaggactggcaggacttcatcatcaagacctacaaagagggcaacaagggcagcaagcggatcagccctctgcaggtttccatgagagtgaaagtgcgggcctctgagctgggccagaaagagtaccctagctaccggaccgtgtacagggtgctgcagcctgtgattgagcagcaagagcagaaagccaaagtgcggagcagaggctggcggggatctagactgctggttaagaccagagagggcaaagacctgagcgtggaatactccaaccacgtgtggcagtgcgatcacaccctggtggatctgctgctggtggatagacacggcgagattgtgggcagaccttggctgaccaccgtgatcgatacctacagccggtgcatcatgggcatcaacctgggcttcaatgcccctagctctcaggtggtggctctggccctgagacacgccattatgcccaagcactacagcagagagtacgagctgtacgaggaatggggcacctatggcagccccgagcacttttacacagacggcggcaaggacttcagaagcaaccatctgcagcagattggcgtgcagctgggcttcgcctgtcacctgagaaacagacctagcgaaggcggcatcgtggaaagacccttcggcaccttcaacaccgagctgttctctaccctgcctggctacaccggcagcaatgtgcagcagaggcctaaagaggccgagaaagaggcctgcgtcaccctgagagagctggaaaagctgctcgtgcggttcatcgtggacaagtacaaccagagcatcgacgccagaagcggcgaccagaccagattccagagatgggaggccggactgatcgccgtgcctaacatgatcagcgagcgcgacctggacatctgcctgatgaagcagaccagacggaccatctaccgcagcggctacatccagttcgagaacctgacctacaagggcgagaacctcggaggatacgccggcgaaaatgtggtgctgagatacgaccccagagacatcaccaccgtgtgggtgtacagacggaagggctccaaagaagagttcctggccagagctttcgcccaggacctggaaaccgaacagctgtctctggatgaggccaaggccagctccagaaaagttcgcgaggccggcaagaccgtgtccaacagatctatcctggccgaagtgcgggacagacagatcttcaccacacagaaaaagaccaagaaagagcggcgcaagaccgagcaggccgaactgattcaggccaagcagccactgcctgtggaactggaagtggaagaagaggtggaaaccgtcagcaccggctccgagcctgagtatcagatgcctgaggccttcgactacgagcagatgagagaggactacggcttctga

SEQ ID NO: 1037 - DNA, 837 bp, Calothrix parasitica
atgaccaatcagcaggcacaggcagttgcacagcagctgggtgcaattccgaccaataatgaaaaacagcaggcagatattcagcgtctgcagggtaaaagctttgttccgctggaaaaagttaaagtgctgcataattggctggaaggtaaacgtcagagccgtctgagcggtcgtgttgttggtgaaagccgtaccggtaaaaccatgggttgtgatgcatatcgtctgcgtcataaaccgattcagaaacatggtaaaccgcctaccgttccggttgtttatattcagattccgcaagaatgtggtgccaaagacctgtttagcatgattatcgaacatctgaagtttcagctggataaaggcaccgttgcaatttttcgtaatcgtgcatttgaagttctggaacgttgtgcagttgaaatggtgattattgatgaagccgatcgtctgaaaccgaaaacctttgccgaagttcgtgatatctttgacaaactgcagattccggttattctggttggtacagatcgtctggatgcagttattaaacgtgatgaacaggtgtataatcgttttcgtgcatgtcatcgttttggtaaactgagcggtgaagattttaaacgcaccgtggaaatttgggaaaagcagattctgaaactgccggttgcaagcaatctgagcagcccgaaaatgctgaaaattctggtggatgcaaccggtggttatattggtctgctggatatgattctgcgtgaagcagcaattcgtgcactgaaaaaaggtctgcagaaaatcgatctgaaaaccctgaaagaagtgaccgaagagtacaaataa

SEQ ID NO: 1038 - DNA, 513 bp, Calothrix parasitica
atgcaggccgagaacatccagccttggctgttcagagtggaacccctggaaggcgagagcctgtctcacttcctgggcagattcagacgggccagctacctgacagtgtccggcctgggaaaagaggccgaacttggcggagctgtggccagatgggagaagttcagattcaaccctccacctagccggcagcagctggaaaaactggccgctgtcgtgggagtcgacgtggacagactggttctgatgctgcctccttctggcgtgggcatgaagatggaacccatcagactgtgcggcgcctgttacgccgaaagcagctgccacaagatcaagtggcagttcaagacccggcagggctgcgacagacacaagctgacactgctgagcgagtgccccaattgcggcgccagattcaagatccctgctctgtgggtggacggctggtgccacagatgcttcacccctttcgaggaaatggtcaagttccagaaggacatcaacaccgactga

SEQ ID NO: 1039 - DNA, 1953 bp, Calothrix parasitica
atgagcttcaagaccatccagtgccggctggtggccgaggaatctacaagacagcagctgtggcagctgatggcccacaagaacacccctctgatcaacgagctgctgctgcaggttgcccagcatcctgactttgagacatggcggaagaagggcaagatcgccaagggcatcatcacccagctgtgccagagcctgaaaaccgacctgcggtttatcggccagccaggcagattctacaccagcgccatcaccttcgtggactgcatctacaagtcctggctggaactgatgaagctgaaccagcggcggctggaaggcaagaacagatggcagaagatgctgaagtccgacgccgagctggtggaagatagcagcgctagcctggacctgatcagaagcaaggccaccgagattctggcccaggctcagctgaatagcgagagcctgagcgccgagaatcaagagaacaacaagagcgagaagtccatcaagaagcagaagaaggggaaaaagaaaaacaacaaaaagtccgaagagtccgaggaaaacaagtccctgagcaaggccctgttcgacgcctacgagaacaccgaggacatcctgaccagatgcgccatctcctacctgctgaagaacggctgcaaagtgaccaacaaagaagaggaccccgagaagttcaccatccggcggagaaagctggaaatcgagatcgaggacctgcaagagaagctggaagccagactgcccaaggccagagatctgaccgatagcagctggctgaacaacctggaactggccaccaaacaggtgcccgagtctgaggaagaggccaagtcttggcaggacgccctgctgaaaaagtccagcagcgtgccctttccaatcgcctatgagacaaacgaggacatgacctggttcaagaacgagaagggcagaatctgcgtgaagttcaacggcatcggcgagcacaccttcgagatctactgcaacaagcggcagctgcactggtttaagcggtttctgctggaccaagagactaagaagaacagcaacgaccagtacagcagctccctgttcaccctgagaagcggcctgatcctgtggcaagagcgggacaagaaaggcaagccctggaacatcaactatctggccctgcactgctgcgtggacaccagactttggacagccgagggaacacaggtggtggctgaagagaaggccgaagagatcacccggatcatcagcaacgccaagaagaaggacaacctgaacaagaaccagctgaccttcatcaagcggaagaaaaccacactggcccggatcaacaacccctatcctagacctagcaagcccctgtacaagggccagagcaacatcatcctgggcctgtatctgggcctgaaagagcgggccacaatcgccgtggtggatgtgaatgccggcaaggtgctgatcaaccagagcaccaagcaactgctgggaaacaactaccggctgatcgaccggcagcggagacagaagagaaaactgagccaccagcggaagatcgcccagacacagagcaagcccaacaacttcaaagagagcgacctgggcgagtacatcgacagactgctggccaaaaagatcgtggaaattgcccagaagttcagcgccagcagcatcgtgctgcccaagctgaccaacatgagagagcagatcaacagcgagatccaggccaaggccgagaagaagtgccctgagtctatcgaggtgcagaagaaatacgcccaccagtaccggatcaatctgaacaactggtcctacggccggctgacccagaacatccagaatctggcctctcaagtgggcctgaccgtggaagagaatgagcagcctctgaagggcagccccaaagagaaagccaaagaactggccctggtggcctacaaggcccggaacaaatcttga

SEQ ID NO: 1040 - DNA, 443 bp, Calothrix parasitica
tcatcaaagacccaatatttaaaatagagtaataaatagcgccgttgttcatatgaacaatgctaaatgcgggttagtttgactgtgagactacagttttgctttctgaccctagtagctacccaccttgaagctgctatctcttgtaggtaggacatcaggtgcgcccccagtaatagaggtgcgggtttaccgcagtggtggttaccgaatcacctccgagcaaggaggaactcacccttaatttttatttttggcacatcgaagcgggggttattttcctggtacttctgtcaaaatctttaaatccttatctatcaataattttggctttcatagtgtcaagcaatttacttttttaagtattagatgacaggtgattttgatagacctgccaaaaatgcttttaaaagtcttggtaagtaaggggttgaaggtacggg

SEQ ID NO: 1041 - DNA, 37 bp, Calothrix parasitica
gtttcaaagctctttctggctttgagcgagttgaaag

SEQ ID NO: 1042 - DNA, 495 bp, Calothrix parasitica
  misc_feature (472)..(495): n is a, c, g, or t
tcatcaaagacccaatatttaaaatagagtaataaatagcgccgttgttcatatgaacaatgctaaatgcgggttagtttgactgtgagactacagttttgctttctgaccctagtagctacccaccttgaagctgctatctcttgtaggtaggacatcaggtgcgcccccagtaatagaggtgcgggtttaccgcagtggtggttaccgaatcacctccgagcaaggaggaactcacccttaatttttatttttggcacatcgaagcgggggttattttcctggtacttctgtcaaaatctttaaatccttatctatcaataattttggctttcatagtgtcaagcaatttacttttttaagtattagatgacaggtgattttgatagacctgccaaaaatgcttttaaaagtcttggtaagtaaggggttgaaggtacggggaaattctggctttgagcgagttgaaagnnnnnnnnnnnnnnnnnnnnnnnn

SEQ ID NO: 1043 - DNA, 500 bp, Calothrix parasitica
cactttgcaagtagatgaggtacattctttttttgctcgctactcgctacttgctactcgctactcgctactcgctactcgctacttgctacttgctactccctcaaatgattaggtgtagctcacttggatgatgtcgtttgccaaattaaatgaccacttgacaaattaatgtccttaaaaatatttattccaaaacctttgcaatgcaagggttttattgttttaagcctcttcgagatacaaataaggttattgacaaattaagtgtcctcttttgggactttgacaagttatttgtcctttcttgaaaacaaggctttgactgaaaactttacctaacttgacaaaataaatgtcttctaacgttaaaatacaattatgttttattaggcaattaggtttattatgggtgaagattatcccagtgactcattagagtcagaaaccaacgagattgtgacggaactttcctatgaagaaaggcgtgttttagaagt

SEQ ID NO: 1044 - DNA, 500 bp, Calothrix parasitica
gttttaacgcattttcagactttgggctagttgaaagctgcattactaatgagtgtaaaaagtcttgctcaatgcacttggcactttcaagctttgggcaagttaaaagaagcttgatagtgagatacgtgcaattctttcttaggtttcaactttctttcacgctttggcaggttgaaggaaagccaatgcaatcgaaaacaagtaattaagttttaatataaaataaacaataggtgagtggaaagcgaatccagttacgtcctaagcgaatgatttgaagcattcgtggttgatttatatatatatttaaatcaattcagaggacattaatttgtcaacgcggacactaatttggcaaaacggacattaatctggcaacgcggtcaaataatgtggcaagtgacatcacacaacagacaatgttaattatttcaaaaaaatggacgtaactggattcgaaccagtgacctctacgatgtcaacgtagcgctctaacc

SEQ ID NO: 1045 - DNA, 1902 bp, Tolypothrix tenuis
atgcccagaaagcctaccagcgaggcctttcctggcctggaaattgaggaagccgccaatcaagaggaagaacagaccaagcacctcctggtcaacgaggacagcagcgactacctgaagaaggtggaactgatcgacgccatccggcaggcccctaacaaagccgctagaatggatgccattgccgacgccgctaaggccctgggcaagagcacaagaaccatcaagcggatggtggaaaaggtcgagcaagtgggcgttgccacactggccgtgggcagaaaagataagggccagtaccggatcagccagcagtggcacgacttcatcgtgaacctgcacaaatggggcaacagagagggcagcagaatcaaccacaaccagatcttcggctatctgaaagccctcgccagccagggcgaaaagctgctgcacaagaagcacgacgagaagttcaaagagtacagccaagtccgcgaggacctggtggctggaacacacccttctcacgtgaccgtgtacaagatcatcaacagctacctcgagcagaaacacaagaccgtgcggcaccctggaagccctatcgagggacagatcatccagaccaccgagggcatcctggaaatcacccacagcaatcagatctggcaggtcgaccacaccaagctggacatcctgctgatcgatgaagaggacaagaaagtgatcagccggccttacatcaccctggtcatggacagctacagcggctgcgtgaccggcttctatctgggatttgaaccagccggcagccacgaagttggactggctctgagacacgccatcctgcctaagcactacggcaccgagtacgagctgcaggacacctggcagatctacggcatccccgagtacatggtcaccgaccgggccaaagagttcaagagcgagcacctgatccagatcagcctgcagctggacttcaagcggcggctgagagcttttccacaagccggcggactgatcgagacaatcttcggcaccatcaaccagcagatcctgagcctgtacggcggctacacaggcagcagcgtggaagaaagacctcctgaggccgagagaaccgcctgtctgacactggacgacctggaaaagatcctcgtgcggtacttcgtggacaactacaaccggcacgactaccccagagtgaagaaccagaaacggatcgagcggtggaagtcccggctgctggaagaacctgagatcctggaccagagagagctggatatctgcctgatgaaggtcgccatcagaaacgtcgagaagtacggcagcgtgaacttccaaggctgggtgtaccaaggcgactggctgctgaactacgagggcaaacaggtgtccctgagatacgacaagcggaacatcaccagcgtgctggcctacaccagacctatcaatggcgagcccggcgagttcatcggagtgattcaggccagagactgcgagcgcgagagaatgtctctggctgagctgaattacatcaagaagaagctgcgggacgcctgcaaagaggtggacaacagctccatcctgaacgagcggctgagcaccttcgaggacgtggaacagaaccggaaagagcggcggagacacagaagaaagaaggcccagcaaaagcacgaggccaagagcaacaagtccaagatcgtggaactgttccccgagaacctgaccaccgaagagatcattaactcccaagagaacctcaccagcaacttcgacgtgaacgccaagaacatcgtgaatagcatcgacaagcagatcacccagaacaagcccaatcctaaccagaccagcaaggccagacgcagacctagagtgggcgagaaggactggaaccagttcctggaaaacaactggtga

SEQ ID NO: 1046 - DNA, 921 bp, Tolypothrix tenuis
atgagcgagatcaacctggccaacgccaacctggaatttcagaacagctacgacgccagcctgcagagcgctgaggaactgagaagaagccctgaggctcaggccgaggtggaaagaatcggcaaggccaacacctacctgcctctggacagagacaccgagctgttcgactggctggacgatcagagggatgccaagctgtgtggctacgtgacaagcgccacaggctctggactgctgaaagcctgccagctgtacagaacccagtacgtgaagcggagaggcaccctgctggaaatccctgccacagtgctgtacgccgagatcgaacaacacggcggacccaccgatctgtactgcagcatcctggaagagatcggacaccctctggctcacgtgggcacactgagagatctgagatctagagcctggggcaccatcaaaggctacggcgtgaagatcctgatcatcggcaacgccgactacctgacactggaagccttcaacgagctgatcgacgtgttcaccaagatgcggatccccgtgatcctcgtgggcacctactacctgggcgacaatatcctggaacggaagtccctgccttacgtgcgggtgcacgacagctttctggaaagctacgagttccccaacctgaacgaagaggaagtgatcgaggtcgtcaacgactgggaagagaagttcctgcctgagaagcaccggctgaatctgacccagatggaaagcgtggtgtcctacctgcggctgaagtctggcggactgatcgagcctctgtacgacctgctgcggaagatcgccatcctgaagatcgacgagccccacttcgagctgaaccagtacaacctgaccaagagattcggcagacggaaagaacccaaagtgaagttcaagcggaagtcctga

SEQ ID NO: 1047 - DNA, 513 bp, Tolypothrix tenuis
atggaacctgaggtgctgcagaaccctccttggtacatcgagcccaaagagggcgagagcatcagccactacttcggcagattcagacggcacgaggccgtgtgtgttagctctcctggcacactgtctaaggccgttggcatcggacctgtgctggccagatgggagaagttccggttcaacccatttcctagccagaaagagctggaagccatcggcaagctgatcggcctggacgccgatagaattgcccagatgctgcctagcaagggcgagaagatgaagctggaacctatccggctgtgcgccgtgtgttatgccgaacaggcctaccacagactggaatggcagttccagagcaccgtgggctgcgacagacacaagctgagactgctgagcgagtgccccttctgcaaagagagattcgctatccccgctctgtgggagcagggcgagtgtaacaagtgtcacaccccattccggtccatgaagaagcggcagaaggcctactga

SEQ ID NO: 1048 - DNA, 2037 bp, Tolypothrix tenuis
atgagccgggacagacagaagaagtccacctctcctatccaccggaccatccggtgtcatctgcacgcctctgaggacgtgctgcggaaagtgtgggaagagatgacccagaagaacacccctctgatcgtgcagctgctgaagtccgtgtctgagcagcctgagttcgaggccaatcaagagaagggcaccatcagcaagaaagagatcaccaagctgcggaaggccctgaccaacgacagcgatatccagcagcagagcggcagactgggaagctctgccgattctctggtcaccgaggtgtacacaagctggctgaccctgagccagaagatcaagaagcagaaagagggcaaagagtacttcctgaacaacatcctgaagtctgacgtcgagctggtggaagagagcaactgcgacctgcagaccatcagatgcaaggcccaggacatcctgtctcagcccaaagagttcctggaaaagatcatcaacaacgacgccgtgctgaaccagaccaagagcgccagaaagaaggtgcagaacagcagcaacgagatcaacgccagcaagcagtccgagaacagcgacctgaaagaaaacgtggacaagaacatccctcagacgctgaccgagatcctgtacaagatccacaagatcacgcaggacattctgacccagtgcgccgtggcctacctgatcaagaaccacaaccaggtgtccgacatcgaagaggacatcaagaatctgaagaagcggcggaccgagaaacaggtgcagatcaagcggctggaagaacagattcacaacaagaagctgcccaacggccgggacatcaccggcgagagatacaaccaggccttcgacaatctgatcaatcaggtgccccaggacaacgaggaattcgccgagtggatcgccagcctgagcaccaaagtgtcccatctgccttatcctatcgactacctgtactccgacctgacctggtacaagaacgagcaagagaagatctgcgtgtacttcaacggctgggccaagttccacttccaaatctgctgcaacaagcgccagctgcacttcttcaagagctttctcgaggactacaaggccctcaaagagagcgagaagggcgagacaaagctgagcggaagcctggtcacactgcgctctgttcagctgctgtggcaacaaggcgaaggtgctggcgctccctggaaagtgaacaaactggccctgcactgcacctacgacgccagactgcttacagccgagggcacagaagatgtgcggcaagagaaaaccgacacgacccagaaacaagtgaccaaggccgaggccaacgagaacatcgatagcgacgagcagaagaacctgaaccggaacatcagctccctgagccggctgaacaatagcttcgccagacctagcaagcccatctacagaggccagagcaacatcatcgtgggcgtgtccttccatcctgtggaactcgtgacactggccgtggtggacatcatcaccaaagagaaaatcatctgcaagaccgtgaaacagctgctgggcgacgcctttagcctgctgtctagaaggcggaggcagcaggtccacttccggaaagagagaaagaaagcccagaaaaaggacagcccctgcaacatcggcgagtctcagctgggcgagtatgtggataagctgctggccaagcggatcgtggaagtggccaaagagtatcaggccatctgcatcgtgctgcccacactgaaggacacccgcgagatcagaaccagcgtgatccaggccaaagccgagactaagttccccggcgacgttaacgctcagcagctctacgtgaaagagtacaaccaccagatccataactggtcctactctcggctgcaagagagcatcaagagcaaggccgccgagctgaagatcagcatcgagttcagtattcaggccagctacgacaccctgcaagagcaggccatcaatctggccctgagcgcctaccagtgccggatcaataccatcggcagatga

SEQ ID NO: 1049 - DNA, 680 bp, Tolypothrix tenuis
aatttctacctaaatattgtattgtcttttatattaaatcggtgccgtcatatatatatgctctttcgagagttaactatatatgacgcgacagtgtcagcccctttgtgtagatactgtggaatgggttagtttaacgcttgtacaagcgtattctttctgaccctggtagctgccaactcaacctgtgcgttcatctaagcgtttgttagcagtaattgcttgggtaagcaaatgctgctgttagatgagaaaggactcgcaccgagacgcatgggaagtataaggtgttagggtgacaaacagcccagaaccttagctcttgacatcaaactctttttgcttggtgttaggtgacagagcggactatatgactgaaatctgggattttggttgtatgagtacatcattacctcttactttacagcaaagtaagggtacgggtataccgtcatggtggctaccgaactaccaccccctaatttttatttttggcaagtcaaagcaggggcaaaatccctggagtgctgccaaatggctaaaactattgtcttgactgcatttcattcatttcaatgcgaatgcaagtttatttgttagtgatagaaaataggcttttaagtagacttgccaaaatcgcttctggaaaatagtcaggataagagtttgacaagtgcggg

SEQ ID NO: 1050 - DNA, 37 bp, Tolypothrix tenuis
gtttcaataaccctcacggctggtggtgggttgaaag

SEQ ID NO: 1051 - DNA, 732 bp, Tolypothrix tenuis
  misc_feature (709)..(732): n is a, c, g, or t
aatttctacctaaatattgtattgtcttttatattaaatcggtgccgtcatatatatatgctctttcgagagttaactatatatgacgcgacagtgtcagcccctttgtgtagatactgtggaatgggttagtttaacgcttgtacaagcgtattctttctgaccctggtagctgccaactcaacctgtgcgttcatctaagcgtttgttagcagtaattgcttgggtaagcaaatgctgctgttagatgagaaaggactcgcaccgagacgcatgggaagtataaggtgttagggtgacaaacagcccagaaccttagctcttgacatcaaactctttttgcttggtgttaggtgacagagcggactatatgactgaaatctgggattttggttgtatgagtacatcattacctcttactttacagcaaagtaagggtacgggtataccgtcatggtggctaccgaactaccaccccctaatttttatttttggcaagtcaaagcaggggcaaaatccctggagtgctgccaaatggctaaaactattgtcttgactgcatttcattcatttcaatgcgaatgcaagtttatttgttagtgatagaaaataggcttttaagtagacttgccaaaatcgcttctggaaaatagtcaggataagagtttgacaagtgcggggaaatcacggctggtggtgggttgaaagnnnnnnnnnnnnnnnnnnnnnnnn

SEQ ID NO: 1052 - DNA, 500 bp, Tolypothrix tenuis
tcaaaatggtaatcaagaaactttagatagcactgcaactgtagaaatgaaacctggagatgtatttgtgatagaaactccaggcggaggaggatttttttaagagttttgaggagtaagatttgagtaatgaaaatatagtttttccaaaactcaatttatactattgttatcgttaaaaataacgataattatttgacttccatatggtgtccattaaataattattgtccattttaaagaattattgtccattttcaatttatagcgcttatagctgaaacctattcatagcaaggggttcagctattttgtttttagattattcttttcctatttttaaatcaaatgatgtcataaatcatataaaattttaaagtaaatgatgacatattttttggagatgagctgatgcccaggaagcctacgagcgaagcctttccaggattagagattgaggaagcggcaaatcaggaagaagagcaaacaaagcacctact

SEQ ID NO: 1053 - DNA, 500 bp, Tolypothrix tenuis
gtttcaataaccctcacggctggtggtgggttgaaagattttatcgctatgttttcagcaatttcactattatgtcttctattgtaaaattatttattagggtggtttgaaaggagcacttcaatggcatattgccaaaacctgtgcagttgatcccatagatctctagatacatttagagtcaatgtatcttgcgagaaacttaacttaattttggacaataattatttaaaactggtttcaactctggacaataattatttaaaactggtttgagtgctgaaagtcaagaaaataggttacttatgtcccttaactacgtcaaaatggacaagaattctttaaaactgacaataataatttaatgtacatatggagttaagcggattcgaaccgctggccccttcaatgccattgaagtgctctaccaactgagctataaccccggaatacgcgtttctaattatcgctgaataatattatctttgtcaagattggta

SEQ ID NO: 1054 - DNA, 1275 bp, Calothrix species
atgaccgtgtaccggatcctgcagcctctgatcgacaaggtggaaaaggccaagagcatcagaagccccggctggcgaggaagcagactgagcatcaagaccagagatggcaacgatctgcaggtcgagcacagcaatcaagtgtggcagtgcgatcacaccctggtggatgtgctgctggtggacagacacggcaagctgctgtctagaccttggctgaccaccgtgatcgacagctacagcagatgcatcatgggcatcaacctgggctacgacgcccctagctctaaggttgtggctctggccctgagacacgccatcctgcctaagcagtacggcagcgactacggcctgaatgaggaatggggcacatctggcctgcctcagcacttctataccgacggcggcaaggacttcagatccaaccatctgcagcagatcggcgtgcagctgggcttcgttagacacctgagagacagacctagcgaaggcggcagcgtggaaagacccttcaagaccctgaacaccgagctgttcagcaccctgcctggctacaccggcagcaatattcagcagaggcctgaggaagccgagaacgaggcttgtctgacactgcaccagctggaaaagatcctcgtgcggtacatcgtggacaactacaaccagcggatcgacgccagaatgggcgaccagaccagatttcagagatgggagagcggcctgatcgccgctcctgatctgctgtctgagagagagctggacatctgcctgatgaagcagaccagacggcacatccagagaggcggctacctgcagttcgagaacctgatgtaccggggcgagaatctggccggatatgccggcgaaaaggtggtgctgagatacgaccccagagacatcaccaccatcatgatctactgcaccgagggcgacaaagaggtgttcctgaccagagcctacgctcaggacctggaaaccgaggaactgagcctggatgaggccaaggccagcagcagaaaagtgcgcgaagctggacaggccgtgaacaacagatccatcctggccgaagtgcgggaaagagaagtgttccctacacagaaaaagaccaagaaagagcggcagaagctggaacagaccgagctgaagaagtccaagcagcccattcctatcgagccagaggaactggacgaagccgtgtccaccgaggtggaaacagagcctgagatgcccgaggtgttcgactacgagcagatgagagaagattacggctggtga

SEQ ID NO: 1055 - DNA, 849 bp, Calothrix species
atgagcagcaaggccagcacaacagaggcccaggctattgctcagcagctgggagatatccccgccaacaacgagaagctgcaggccgagatccagcggctgaacagaaagggcttcgtgcccctggaacaagtgaaaaccctgcacgactggctggaaggcaagcggcagtctagacagtctggcagagttgtgggcgagagcagaaccggcaagaccatgggctgtgacgcctaccggctgagaaacaagcccaagcaagagagcggcaagcctcctacagtgcccgtggcctacatccagattcctcaagagtgcggcgccaaagaactgttcggcgtgatcatggaacacctgaagtaccaagtgaccaagggcaccgtggccgagattagagacagaaccctgcgggtgctgaaaggctgcggagtggaaatgctgatcatcgacgaggccgaccggttcaagcctaagacctttgccgaagtgcgggacatcttcgacaagctggaaatcgccgtgatcctcgtgggcaccgatagactggatgccgtgatcaagcgggacgaacaggtgtacaaccggttcagaagctgccacagattcggcaagatgtccggcgaggacttcaagcggaccgtggaaatctgggagaagcagatcctgaagctgcctgtggccagcaacctgggcagcaagacaatgctgaaaacactgggcgaagccaccggcggctatatcggactgctggacatgatcctgagagagagcgccatcagagccctgaagaagggcctgcagaagatcgacctggacaccctgaaagaagtgaccgccgagtaccggtga

SEQ ID NO: 1056 - DNA, 507 bp, Calothrix species
atgatggaagccgaggaaatcaaaccctggctgttccaagtggaacccctggaaggcgagagcatcagccactttctgggcagattccggctggccaacgatctgacaccttctggactgggacaagccgctggactcggcggagctattgccagatgggagaagttccggttcaaccctccacctagccggcagcagctggaatctctggctgtggtcgtgggcgtcgacaccgacagactggaaaagatgcttcctcctgccggcgtgggcatgaagatggaacctatcagactgtgcggcgcctgctacggcgaaagcccttgtcacaagatcgagtggcagttcaaagaaaccggcggctgcggcagacacaatctgacactgctgagcgagtgccccaattgcggcgccagattcaaagtgcctgctctgtgggtggacggctggtgccacagatgctttacccctttcgccgagatggtggaacaccagaagcggatctga

SEQ ID NO: 1057 - DNA, 1920 bp, Calothrix species
atgagccagatcaccatcatgtgccggctggtggccaacgagagcacaagacagcaactgtggcagctgatggccgagctgaacacccctctgatcaacgagctgctggtgctgatctcccagcaccaggacttcgagacatggcagcagaagggcaagatccctgccggcacagtgaagcagctgtgcgagagcctgaaaacagaccctggctttgccggacagcccgccagattctatgcctctgctatcgccaccgtgtcctacgtgtacaaggcctggatgaaggtgcagaagcggctgaagtcccagctggaaagcaaggccagatggctgagcatgctgcagagcgacgaggaactgattgccattgctggcgtggacctggacggcctgagaaatcaggccagactgatcctgcagcagttcgcccctgagccttctccacaagaagatctgcaggccaacaagaagcagcccaagaccgagaagtccctgagccagacactgctggacacctacgagagcagcgaggacatcctgaccagatgcgccatctcctacctgctgaagaacggctgcaaggtgtacgagaagcccgagaacagccagaagttcagcaagcacaaggacaagctgaaagtgcagatccagcggctgatccagaaactggaaggcagagtgccccagggcagaaacctgaccgataccgagtggctggaaaccctgatcctggccaccgagaagattccccaggatgaggccgaggccaagagctggcaagacagcctgctgaaaaagtccagcagcgtgatcttccccgtgtcttacgagtccaacgaggacatgacctggttcagaaaccagaaaggccggatctgcatcaagttcaacggcatcagcgagcacaccttcgagatctactgcgacagccggcagctgcattggttcgagagatttctgagcgaccaagagacaaagaagaacagcaagaaccagcacagcagcgccctgttcacactgagatctgccagaatcggctggcacgagcaagagatcaagaacaagcagatctgtcggcggaagcccaccgtgaatccctgggacatctaccacctgacactgtactgcaccgtggacaccagactgtggacagccgaaggcacagctgttgtggccgccgagaaagccgaggaaatcgccaagatcatcaccaagaccaaagagaaggacgacctgaacgagaaacagctggcccacatcaagcggaagaatagcaccctggaacggatcaacaacccctatcctcggcctagcaagcccctgtaccaggccaatcctcacatcctcgtgggagtgtctctgggcctgaagaagcctgccacaatcgccgtggtggacgtgatctctcagaaggtgctgacctactgcagcatcaaacagctgctgggcaagaactacaagctgctgaaccggcacagacagctgaagcacaacttcgcccacaagagaaagatcgcccagacacaggccaagcagcagcagtacctggattctgagctgggccagtacatcgacagactgctggccaaacagattatcgccattgccaagcagtacagcgccagctccattgtgctgccccagctgaatggcatgagagagcagatcaacagcgagatccaggccaaggccaaagaaaagtgccccgagtctatcgaggcccagaagaagtacgccaaacagtaccggcggagcatcaaccagtggtcctatggcaggctgatcgagagcatcatcagccagggactgcaggccggaatcgccatcgaggaatctaaacaggccgtgcagggcagccctcaagagaaggctaaagaactggccttcgtggcctacaacagccggaagaagtcctga

SEQ ID NO: 1058 - DNA, 517 bp, Calothrix species
cgcacaaattgcgtccgaaccatgaaaatagaataaataattaacagcgccgttgttcatgcgttttttgcgtctctgagcaatgataaatttgggttagtttgactgttggaaatacagtcttgctttctgaccctggtagctgcccaccttgaagctgctatctcttgtagataggacataaggtgcgcccccagtaatagaggtgcgggtttaccgcagtggtgagtccacttaccgggaagatgttattttcggtaaagtggcgaatccgaagggtggctactgaatcacctccgagcaaggaggaacccaccttaattattttttggcatggcaaagcgggggcgattccctgggactcctgccaaatcttcaaatccctttattggtattctttctagagtttggactgtcacttgatttacttttttcagtgtcaaccagcaggtggttttggtagtcctgtcaaaagtacttctaggaggcttaataaataaagggtttcaggcgcgga

SEQ ID NO: 1059 - DNA, 37 bp, Calothrix species
gtttcaatgcccctcctagcttgaggcgggttgaaag

SEQ ID NO: 1060 - DNA, 569 bp, Calothrix species
  misc_feature (546)..(569): n is a, c, g, or t
cgcacaaattgcgtccgaaccatgaaaatagaataaataattaacagcgccgttgttcatgcgttttttgcgtctctgagcaatgataaatttgggttagtttgactgttggaaatacagtcttgctttctgaccctggtagctgcccaccttgaagctgctatctcttgtagataggacataaggtgcgcccccagtaatagaggtgcgggtttaccgcagtggtgagtccacttaccgggaagatgttattttcggtaaagtggcgaatccgaagggtggctactgaatcacctccgagcaaggaggaacccaccttaattattttttggcatggcaaagcgggggcgattccctgggactcctgccaaatcttcaaatccctttattggtattctttctagagtttggactgtcacttgatttacttttttcagtgtcaaccagcaggtggttttggtagtcctgtcaaaagtacttctaggaggcttaataaataaagggtttcaggcgcggagaaatcctagcttgaggcgggttgaaagnnnnnnnnnnnnnnnnnnnnnnnn

SEQ ID NO: 1061 - DNA, 500 bp, Calothrix species
gattcgacctgatttggagtaaaatgaaacaaattgaagtttgactcgttgaggctgggtgctgcttctggagccgaaaacgagggaatattaatgtacattaactaattatttgtcaatttaacaaaataattgtcatattattcaaaatcactcaatccctgtcattgcaataactatgacagggattttgttattacaaccagtcacagcgctttcagctttgattcacaaattagatgtcaaaatccagaattttcacaatttaattgtcacttctcaaaaatagtagacaatcatgattttgcataaattaacacattaattgtcacattattagtataatacaactatgttttgataaagcactgtatgcaggatgcagaattttctacaacttctacgacaaaggtaagttgcacagatgttaatagcactgaagcaaacattattgtttccgaactttcggatgaagctttgttgaaaatggaggtaattca

SEQ ID NO: 1062 - DNA, 500 bp, Calothrix species
gtttcaatgcccctcctagcttgaggcggaaagacctcttggcgatgcgattgcctttaatttggcagtttcaagtaaatagttggttaaaatatttaaggtgggttgaaaggtaaggcagaggtctgccattaaaaaatgccacatgcatgaggcagtgacatttattttgttaacattgacatcaatctgttagaaatgacattaatttgttaacagtgacaaataattagttaatgtacaacaaacaaaggcgacacccggatttgaaccgggggatggaggttttgcagacctctgccttaccacttggctatgtcgccacaactaacaattacatatattagcaccatttcgaatattattccacttttttcagcaacaggttaattttaccaccagtaatacgactatcagggcataaaccaagccatgaggtaaaatgcttgactgtagcaatgccttcgccagatttctgagtgatgacgtagtatcaaagc

SEQ ID NO: 1063 - DNA, 1746 bp, Trichormus variabilis
atgtaccagcagctgcaggatagctaccccgccaatgatgatggcgccgtggaactgcagaagcaccagaacagcaccaagaccagcagcaagctgcccagcgagaagctgatcaccgacgacgtgaagctgcggatggaagtgatccagagcctgaccgagccttgcgacagaaagacctactccgagaagaagaaagaggccgccgagaaactgggcgtgaccatcagacaggtggaacggctgctgaagaagtggcgcgaggaaggacttgtcggcctggccacaacaagagccgacaagggcaagtaccggctggaacaagagtgggtcgacttcatcatcaacacctacaccaacggcaacaagaaaggcaagcagatgacccggcaccaggtgttcctcaaagtgaagggcgaagccaaagagaagggcctgaagaaaggcgagtaccccagccaccagagcatctacagaatcctggacaagcacatcgagggcaaagagcggaaggacaacgccagatctcctggctacagcggcgaaaagctgacccacatgacccgcgacggcagagaactggaagtggaaggcagcaacgacgtgtggcagtgcgatcacaccagactggacgtgatgctggtggacgagtacggcgtgctggatagaccttggctgaccatcgtgatcgacagctacagcagatgcgtgatgggcttctacctgggcttcgatcaccccagcagccagattgatgccctggctctgcaccacgccatcctgcctaagagctacagctccgagtacaccctgagacacgagtgggttgcctacggcaagcccaactacttctacaccgacggcggcaaggacttcacctccatccacaccacagaacaggtggccgtgcagatcggctttagctgtgccctgagaagaaggcctagcgacggcggaatcgtggaacggttcttcaagaccctgaacgaacaggtgctgaacaccctgccaggctacaccggctctaatgtgcagcagaggcccgagaacgtggacaagaatgcctgtctgaccctgaaaaacctggaaatggtgctcgtgcggtacatcgtggatgagtacaaccagcacaccgacgccagaatgaaggaccagagcagaatcggcagatgggaggccggctctatggtggaaccctacctgtacaacgagctggacctggccatctgcctgatgaagcaagagcggcggaaggtgcagaagtacggctgcatccagttcgagaacctgacctacagagccgaccacctgagaggcagagatggggaaacagtggccctgagatacgaccccgccgatgtgacaacactgctggtgtatgagatcaacgccgacggcaccgaggaatttctggactatgcccacgctcagagcctggaaacagagcacctgagcctgagagagctgaaggccatcaacaagcggctgaaagaagccagcgaggaaatcaacaacgacagcatcctggaagccatgctggacagacaggccttcgtggaacagaccgtgaagcagaaccggaagcagagaaggcaggccgccagcgagcaagtgaatcctgtggaacccgtggccaagaaattcgccgtgcctgagcctaaagaggtggaaaccgacagcgagcccgacatggaactgcccaattacgaagtgcgctacatggacgagttcttcgaggaagattga

SEQ ID NO: 1064 - DNA, 828 bp, Trichormus variabilis
atgaccgatgccaagcctctggacttcatccaagagcctaccagagagattcaggcccacatcgagagactgagcagagccccttacctggaactgaatcaagtgaagtcctgccacacctggatgtacgagctggtcatcagcagaatgaccggcctgctcgtgggcgagtctagatctggcaagaccgtgacctgcaaggccttccggaacaactacaacaacctgcggcagggccaagagcagagaatcaagcccgtggtgtatatccagatcagcaagaactgcggcagccgcgagctgttcgtgaagattctgaaggccctgaacaagcccagcaacggcacaatcgccgacctgagagagagaaccctggacagcctggaaatccaccaggtggaaatgctgatcatcgacgaggccaaccacctgaagatcgagacattcagcgacgtgcggcacatctacgacgaggactccctgaagattagcgtgctgcttgtgggcaccacctccagactgctggccgtggttaagagggatgagcaggtcgtgaaccgcttcctggaaaagttcgagatcgacaagctggaagagaaccagttcaagcagatgatccaagtgtgggagcgcgacgtgctgagactgcctgaggaatctaaactggccagcggcgagagcttcaagctgctgaagcagagcaccaacaagctgatcggccggctggacatgatcctgagaaaggccgccatcagaagcctgctgcggggctacaagaaagtggatcagggcgtgctgaaagagatcatcaccgccaccaagttctga

SEQ ID NO: 1065 - DNA, 522 bp, Trichormus variabilis
atgcgcgagagcatcaacgagaacaagcagttctggctgatcagagtggaacccctggaaggcgagtccatcagccactttctgggcagattcagaagagagaagggcaacaagttcagcgcccctagcggactgggagatgttgctggacttggagccgtgctggccagatgggagaagttctacttcaacccatttccgacgcaccaagagctggaagccctggcctctgtggtgcaagtggatgtggaccggctgagacagatgttgcctcctctgggcgtgtccatgaagcacagccctatcagactgtgcggcgcctgttatgccgagtctccctgtcacaagatcgagtggcagttcaagaaaaccgtgggctgcgaccggcaccagctgagactgctgtctaagtgtcccgtgtgcgagaagccctttcctgtgcctgctctgtgggtggacggcatctgcaacagatgcttcacccctttcgccgagatggcccagtaccagaagcactactga

SEQ ID NO: 1066 - DNA, 1931 bp, Trichormus variabilis
atgagcgtgatcaccatccagtgcagactgatcgccagcgaggccaccagatcttacctgtggcagctgatggcccagaagaacacccctctgatcaacgagctgatcgagcagctgggcattcaccccgagattgagcagtggctgaagaagggcaaactgcccgacggcgttgtgaagcctctgtgcgatagcctgatcacccaagagagcttcgccaaccagcctaagcggttcaacaagagcgccatcgaggtggtcgagtacatctacaagagctggctggccctgcagaaagagcggcagcagaccatcgaccggaaagaacactggctgaaaatgctgaagtccgacgtggaactggaacaagagtccaagtgcaccctggacgccatcagaagccaggccacaaagatcctgcctaagtatctggcccagagcgagcagaacaacaatcagacccagagccagaacaagaagaagtccaagaagtctaagaccaagaacgagaacagcaccctgttcgacatcctgttcaaggcctacgacaaggccaagaatcccctgaacagatgtaccctggcctacctgctgaagaacaactgccaggtgtcccagaaggacgaggaccccaatcagtacgccctgcggagatccaagaaagagaaagagatcgagcgcctgaagaagcagctgcagagcagaaagcccaacggcagagatctgaccggcagagagtggcagcaaaccctgatcatggccacctctagcgtgcccgagagcaacgacgaggccaacatctggcagaagcggctgctgaaaaaggacatcagcctgccttttccaatccggttccggaccaacgaggacctgatctggtccaagaatgaagagggcagaatctgcgtgtccttcagcggcgagggcctgaacgatcacatcttcgagatctactgcggcaaccggcagatccactggttccagcggtttctggaagatcagaacatcaagaatgacaacaacgaccagcacagcagcgccctgttcacactgagatctgccatcctggcctggcaagagaacaagcagcacaaagagaactccctgccttggaacaccagacggctgaccctgtactgcacactggacaccagactgtggaccaccgacggcaccgagaaagtgaagcaagagaaggtggacgagttcacccagcagctggccaacatggaacagaaagaaaacctgaaccagaaccagcagaactacgtgaagaggctgcagtctaccctgaacaagctgaacaacgcctatcctcggcacaaccacgacctgtaccagggcaagccttctatcctcgtgggagtgtctctgggcctcgagaaacctgccacactggccatcgtggacagcagcaccaatatcgtgctggcctacagatccatcaagcaactgctgggcgacaactacaagctgctgaacagacagcgccagcagcagcagagaaacagccacgagagacacaaggcccagaaaagcaacatgcccaacaagctgtccgagagcgacctgggcaagtacatcgacaatctgctggcccaggccatcattgccctggccaaaaattaccaggccggctccatcgtgctgcccaccatgaagaatgtgcgcgagagcatccagtccgagatcgaagccagagccgtgaagagatgccccaactacaaagagggccagcaacagtacgccaagcagtacagacagagcattcaccggtggtcctacaaccggctgatgcagttcatccagtctcaggccgtgaaggccaatatcagcatcgagcagggccctcagcctatcagaggcagctctcaagagaaagctcgcgacctggccattgccgcctactacctgagacagaacaagtcctg

SEQ ID NO: 1067 - DNA, 446 bp, Trichormus variabilis
tttttgattaagcaaatatactgaaccttgacaataaaataagtaatagcgccgcagttcatgttaaacctctgaactgtgaaaaatctgggttaggttgactattggaaaatagtcctgctttctgaccctggtagctgctcaccccgatgctgctgtttccgaacaggaattaggtgcgctcccagcaataagggcgcggatatactgctgtagtggctaccgaatcacctccgatcaaggaggaacccataccaatccttgtttccaggcattagaagagattaaaaattttcagtcgattcgcgcttgcttgctgtgaaaggattttagcgtttaatggcacaaaaattgctcattcaaacggcagttgaagaagctaggaatatagatccgcgctatcaactctggaatcctccacaaaacaaggattctatacaggaagg

SEQ ID NO: 1068 - DNA, 37 bp, Trichormus variabilis
gtgacaatagcccttcccgtgttgagcgggttgaaag

SEQ ID NO: 1069 - DNA, 498 bp, Trichormus variabilis
  misc_feature (475)..(498): n is a, c, g, or t
tttttgattaagcaaatatactgaaccttgacaataaaataagtaatagcgccgcagttcatgttaaacctctgaactgtgaaaaatctgggttaggttgactattggaaaatagtcctgctttctgaccctggtagctgctcaccccgatgctgctgtttccgaacaggaattaggtgcgctcccagcaataagggcgcggatatactgctgtagtggctaccgaatcacctccgatcaaggaggaacccataccaatccttgtttccaggcattagaagagattaaaaattttcagtcgattcgcgcttgcttgctgtgaaaggattttagcgtttaatggcacaaaaattgctcattcaaacggcagttgaagaagctaggaatatagatccgcgctatcaactctggaatcctccacaaaacaaggattctatacaggaagggaaattcccgtgttgagcgggttgaaagnnnnnnnnnnnnnnnnnnnnnnnn

SEQ ID NO: 1070 - DNA, 500 bp, Trichormus variabilis
atgtctacttgtggtaaaaatagtgtttttgcttgccactaacacagaaaaataaaggaagcaatatgtataaattattacaagctgtacattcacatattagatgtcgctatttaacaaattaatgtcgcaagctttaaagcataaaaccctttccccgtaaggattttatagatttatatgattgtataaaagtgactagagatttttcatggttttcacaaattgaggtcgcaaacccgataatttcacaatttaagagtcgtttattttcttcagccagacaacctaacgttaaacggcttcacgaattagatgtcgcattcctgagagtggcaatatatttacttactctaaaagataaaacctgattaatggcagtatggctgcatcagtgctggaaaattaactgtcttatcctatttcagtgtataactaaaaaaattagctactaatcttacataacgaggtttcagttgtggcgtttcaacctgaagaca

SEQ ID NO: 1071 - DNA, 565 bp, Trichormus variabilis
taattatgtatgtattcatctccattaggatgggtgagagtgataataaccattcacgaaagaatggattgaaaatgtaatacctaacgataaacagaaataggcaagttatataaatctttccggtgcaggactggttgaaatataaagattacaagatgtgggtatgggttgaaagggttcaaatccgtctgcttaacttttgctgccaagcatagtggttagaataattgtgtgcgaaataaagaacaaaagttttttgtttaaccaaggtatagcaaaagtttttagagcttgagctaaaattgagcttatggtcttctatttgataggactgatgttgaccaatcaccccacacaatcgattagtctcaaatattgcgacattaatttgtgaacggttatcttaaatgagccgcgacactaattagtgaaacagcgacattaatgtgtgaacggcgacatctaatgtgtgaatgtacaacaagctaagagcttctttcggtcggaggtttaacctaaagccagcagtcggatttgaaccgacgaccttccgattacaagt

SEQ ID NO: 1072 - DNA, 1755 bp, Nostoc punctiforme
atgaacagccagcagaaccccgatctggccgtgcatcctagcgccattcctatcgaaggactgctgggcgagagcgacatcaccctggaaaagaacgtgatcgccacacagctgagcgaggaagcccagctgaagctggaagtgatccagagcctgctggaaccctgcgacagaaccacatacggccagaagctgagagaggccgccgagaaactgggagtgtctctgagaaccgtgcagcggctggtcaagaactgggagcatgatggactcgtgggcctgacacagacaggcagagccgataagggcaagcacagaatcggcgagttctgggagaagttcatcaccaagacctacaacgagggcaacaagggcagcaagcggatgacccctaaacaggtggccctgagagtggaagccaaggccagagaactgaaggacagcaagcctcctaactacaagaccgtgctgagagtgctggcccctattctggaaaagcaagagaaggccaagagcatcagaagccctggctggcggggaacaaccctgagcgtgaaaaccagagagggcaaagacctgtccgtggactacagcaaccacgtgtggcagtgcgaccacaccagagtggatgtgctgctggtggatcagcacggcgagctgctttctagaccttggctgaccaccgtgatcgacacctacagcagatgcatcatgggcatcaacctgggcttcgacgccccttctagcggagttgttgctctggctctgcggcacgccattctgcctaagcagtacggcttcgagtacaagctgcactgcgagtggggcacctatggcaagcctgagcacttctacaccgacggcggcaaggacttcagaagcaaccacctgtctcagatcggcgcccagctcggctttgtgtgccacctgagagacagacctagcgaaggcggcgtggtggaaagacccttcaagaccctgaacgaccagctgttcagcaccctgcctggctacacaggcagcaacgtgcaagagaggcctaaggacgccgagaaggatgccagactgaccctgagagagctggaacagctgctgatccggtacatcgtggaccggtacaaccagagcatcgacgccagaatgggcgatcagaccagattcgagagatgggaggccggactgcctacagtgcctgtgcctattccagagcgcgacctggacatctgcctgatgaagcagagcagacggacagtgcagagaggcggctgtctgcagttccagaacctgatgtacagaggcgagtacctggccggctatgccggcgagacagtgaacctgagattcgaccccagagacatcaccaccatcctggtgtaccggcaagagaacaatcaagaggtgttcctgaccagggctcacgcccagggactcgaaacagaacaactggccctggatgaagccgaagccgctagcagaaggctgagaaacgccggcaagaccatcagcaatcagtccctgctgcaagaggtggtggacagagatgccctggtggccactaagaagtcccggaaagagcggcagaaactggaacaggctgtgctgagatctgccggcgtggacgagagcaagacagagtcactgtctagccaggtggtcgagcccgatgaggtggaaagcacagagacagtgcacagccagtacgaggacatggaagtgtgggactacgagcagctgcgggaagagtatggcttctga

SEQ ID NO: 1073 - DNA, 831 bp, Nostoc punctiforme
atgacagaggcccaggccattgccaaacagctcggcggagtgaagcccgacgatgaatggctgcaggccgagatcgctagactgaagggcaagagcatcgtgcccctgcagcaagtgaaaaccctgcacgattggctggacggcaagcggaaagccagacagagctgtagagtcgtgggcgagagcagaaccggaaagaccgtggcctgtgacgcctaccggtacagacagaaaccccagcaagaagtgggcagacctcctatcgtgcccgtggtgtatatccagcctcctcagaagtgcggcagcaaggacctgttcaaagagatgatcgagtacctgaagttccgggccaccaagggcaccgtgtccgatttcagaggcagagccatggaagtgctgaaaggctgcggcgtggaaatgctgatcatcgacgaggccgaccggctgaagcctgagacatttgctgaagtgcgggacatctacgacaagctgggaatcgccgtggtgctcgtgggcaccgatagactggaagccgtgatcaagcgggacgaacaggtgtacaaccggttcagagcctgccacagattcggcaagctgagcggcaaggacttccaggatacagtgcaggcctgggaagatcgggtgctgaagctgcctgtgtccagcaacctgacctccaaggacatgctgcggatcctgacaagcgccaccgagggctatatcggcagactggacgagatcctgagagagacagccatccgcagcctgagcaagggcttcaagaaaatcgacaaggccgtgctgcaagaggtggccaaagagtacaagtaa

SEQ ID NO: 1074 - DNA, 501 bp, Nostoc punctiforme
atgaccacacctgacgtgaagccctggctgttcatcatcgagccctatcctggcgagagcctgagccacttcctgggcagattcagacgggccaaccatctgtctccagccggacttggaggactggccggaattggagctgtggtggccagatgggagagattccacttcaaccccagacctagccagaaagagctggaagccattgccagcgtggtggaagtggatgcccagagactggctcagatgcttcctcctgctggcgtgggaatgcagcacgagcctattagactgtgcggcgcctgttatgccgaggctccttgtcacagaatcgagtggcagtacaagtccgtgtggaagtgcgaccggcaccagctgaagatcctggccaagtgtcccaactgtcaggcccctttcaagatgcccgctctgtgggaggatggctgctgccacagatgcagaacactgttcgccgagatggccaagcagcagaagtcctga

SEQ ID NO: 1075 - DNA, 1920 bp, Nostoc punctiforme
atgagccagatcaccatccagtgcagactgatcgccagcgagagcaccagacagaaactgtggaagctgatggccacactgaacacccctctgatcaacgagctgatcgagcagctgggcaagcaccccgacttcgagaattggagacagcagggcaagctgcccaccaccgttgtgtctcagctgtgccagcctctgaaaacagaccccagattcgtgggccagcctagcagactgtacatgagcgccatccacatcgtggactacatctacaagagctggctggccatccagaagcggctgcagcaacagctggacggcaagatgagatggctggaaatgctgaacagcgacgtggaactggtggaaaccagcggcagctctatgggcgccatcagaacaaaggcctccgagatcctggccaaggccatgcctacaagcgacagcgatagcagccagcctaagaccaagaagggcaaagaggccaagaagtccagcagcagctccagcgatagatccctgagcaacaagctgttcgaggcctaccaagagacagaggacatcctgagcagaagcgccatctcctacctgctgaagaacggctgcaagctgagcgacaaagaagaggacagcgagaagttcgccaagcggcggagacaggtggaaatccagatccagagactgaccgagaagctgatctccagaatgcccaagggccgcgacctgaccaacagaaagtggctcgagacactgttcaccgccaccaccacctttccagaggataacgccgaggccaagcggtggcaggacattctgctgaccagacctagcagcctgccttttccactggtgttcgagacaaacgaggacatggtctggtccaagaaccagaaaggccggctgtgcgtgcacttcaacggcctgagcgatctgagcttcgaggtgtactgcgacaaccggcagctgcactggttccagcggtttctcgaggaccagcagaccaagaggcagtccaagagccagtacagcagcggcctgttcaccctgagaaatggccacctcgtgtggcaagaaggcgagggcaaaagcgagccctggaacctgaaccggctgaacctgtactgctgcgtggacaacagactgtggaccgccgatggcacagagcaagtgcggcaagagaaggccgaggaaatcagcaagctgatcaccaagatgaaggaaaagagcgacctgaaggacacccagaaggcctttatccagcggaaagagtctaccctgaaccgcatgaacaacagcttcgagaggcccagccagccactgtatcagggccagtctcatatcctcgtgggcgtgtcactgggactcgagaagcctgctacagtcgccgtggtggatgccattgccggaaaggttctggcctaccggtccatcagacagctgctgggcgacaactacgagctgctgaatagacagcggcggcagcagagaagcagcagccacgaaagacacaaggcccagaagtctttcagccccaaccagttcggcacaagcgagctgggccagtacgttgacagactgctggccaaagagatcattgctatcgcccagacctacaaggccggcaacatcgtgctgcctaagctgggagacatgcgcgagatcgtgcagagcgagattcaggctatcgccgaggctaagtgtcccggctctgtggaagtgcagcagaagtatgccaagcagtatcgcgtgaacgtgcacaagtggtcctacggcaggctgatccagagcatccagtctaagggaagccaggccggcatcgtgatcgaagagggaaagcagcctgtgcggggatctcctcacgagcaggctaaagaactggctctgagcgcctaccacgaccggctggctagaagatcttga

SEQ ID NO: 1076 - DNA, 445 bp, Nostoc punctiforme
caaatatctgaaccttgacaatagaatattaatagcgccgcaattcatgctgcttgcagcctctgaactgtgttaaatgagggttagtttgactgtagcaatatagtcttgctttctgaccctagtagctgctcaccctgatgctgctgtctttatgacaggataggtgcgctcccagcaataagggcgcggatgtactgctgtagtggctactgaatcacccccgatcaagggggaaccctccccaattcttcatttgaaggactaaaatcaaggcaaaatttctaagagtttcgcgcaagttccaaataccttgccccgtctgaatttatcgtttttccatacagatatgattcttgtgactgaggctcaaataggaaattgggaaacatacgcgctgaggaaatctagaaaagttgccctacaatattttgaaactgagtgg

SEQ ID NO: 1077 - DNA, 37 bp, Nostoc punctiforme
gtggcaacaaccctccaggtactgggtgggttgaaag

SEQ ID NO: 1078 - DNA, 497 bp, Nostoc punctiforme
  misc_feature (474)..(497): n is a, c, g, or t
caaatatctgaaccttgacaatagaatattaatagcgccgcaattcatgctgcttgcagcctctgaactgtgttaaatgagggttagtttgactgtagcaatatagtcttgctttctgaccctagtagctgctcaccctgatgctgctgtctttatgacaggataggtgcgctcccagcaataagggcgcggatgtactgctgtagtggctactgaatcacccccgatcaagggggaaccctccccaattcttcatttgaaggactaaaatcaaggcaaaatttctaagagtttcgcgcaagttccaaataccttgccccgtctgaatttatcgtttttccatacagatatgattcttgtgactgaggctcaaataggaaattgggaaacatacgcgctgaggaaatctagaaaagttgccctacaatattttgaaactgagtgggaaatccaggtactgggtgggttgaaagnnnnnnnnnnnnnnnnnnnnnnnn

SEQ ID NO: 1079 - DNA, 500 bp, Nostoc punctiforme
cctttatcaccaaagtattcaatattttctcttaaccgaactttactgtttttaagtatgcaaaaattattgtacattaactaattatttgtcattgtacaaaaatgtacagtgactaattatatgtcgtcgagacaaattaatgtcatccattaaaatcttgctcggtataggttacagcgttttagtagtattaggataacatcttgacagtgacagattagctgtcattttgggtaatagtgacaaattagctgtcgcttcatcagagataaaaaagcttttgtgtattttcataatgacaaattgactgtcgctttctgtttaagtagaataacaatatgtttttataaaaaagcttcgcattatgaacagtcagcaaaatcctgatttagctgttcatccctcggcaattcctatagaaggcttactaggagaaagcgatataactcttgagaagaatgtaattgccacacaactctcagaggaagcccaactca

SEQ ID NO: 1080 - DNA, 500 bp, Nostoc punctiforme
gcaaatctgaaatcattacgcacgcatacaaaaatgttttaataacctgccaggtactaggtgggttatcataatttttattagggagggttgaaagagagcgctacgttgacattatcgctatagtctctgtaaataaatgacattaatctgtcactggcacctaaacgacatcaattcgtcccgacgacagttaattagtcccaacgacattaatctgtcaccgacgacaaataattagtcactgtacaaaaaaaatggacgtaactggattcgaaccagtgacctctacgatgtcaacgtagcgctctaaccaactgagctatacgtccttaaccacacgaatattgatagtagcatatacttttgcgatcgcacaagataaagacccaagctttttaagggggttttagattttgagtgcgtaaatcctaatttcaaataaaatccttattatttcgttacaatcagcttgtgcgttaagcattcaagagttatca

SEQ ID NO: 1081 - DNA, 1677 bp, Cyanothece species
atgaacacattccccaacgagcagagcaacgccatcgtgctgaagaacaccatcgtgtccgacctgcctgagacagccagagccaagatggaagtgatccagacactgctggaaccctgcgacagaaccacctacggcgagagacttagagagggcgccaagaaactgggagtgtctgtgcggacagtgcagcggctgttcaagcagtaccaagagcaaggactggccgctctggtgtccatggaaagagccgataagggcaagcaccggatcaacgagttctggcaggacttcatcgtgaaaacctaccagcagggcaacaagggcagcaagcggatgacccctaaacaggtggccctgaaggtgcaggccaaggctctggaaatcggcgacgaacagcctcctacctatcggaccgtgctgagagtgctgaagcccatccaagagaagcaagaaaagaccaagtccatcagaagccccggctggcggggatctacactgagcgtgaaaacaagagatggcgacgacctggaaatcaactacagcaatcaagtgtggcagtgcgaccacaccagggccgatgttctgctggtggatagacacggcgagctgatcggtagaccttggctgaccaccgtgatcgacagctacagcagatgcatcatgggcatcaacctgggcttcgacgcccctagttctcaggttgtggcactggccctgaggcacgccattctgcctaagagatacggcgacgagtacaagctgcactgcgagtgggagacaagcggcacccctgagtacttctacaccgacggcggcaaggacttcagaagcaaccatctggcccagatcggcagccagctgggattcgtgcacaagctgagagacagacctagcgaaggcggcatcgtggaaagacccttcaagaccctgaaccagagcctgttcagcaccctgcctggctacacaggcagcaacgtgcaagagaggcctaaagaggccgagaaagaggccagcctgacactgagagagctggaacagctgatcgtgcggttcatcgtggacaagtacaaccagagcatcgacgcccggatgggcgaccagacaagataccagagatgggaggccggactgagaaggcagcctgagcctatcagcgagcgcgagctggatatctgcctgatgaaggccgctcggagaacagtgcagagaggcggctatctgcagttcgagaacgtgatgtaccggggcgagtacctggaaggctatgccggcgataccgtgatcctgagatacgagcccagagacatcaccaccatctgggtgtaccggcagaaaaagcaccaagaggtgttcctcaccagagcacatgcccaggatctggaaaccgagcagctgtctgtggacgaggccaaagcctctgccaaaaaactgagagatgccggcaagaccatcagcaaccagtccatcctgcaagaagtgatcgagagagaggccctggtcgagaagaagtcccggaagcagagacagaaggccgagcaggcctacaagcaagagaaacagcccagcatcatcgagacagtggaacccattgagcccgagcctctgacacagaccgaggtggacgatatcgaagtgtgggactacgaccagctgcgggacgattatggctggtga

SEQ ID NO: 1082 - DNA, 831 bp, Cyanothece species
atgacacaggcccaagagatcgcccagaagctgggcgacctgaatcctgatgaacagtggctgcagatggaaatcgcccggctgaacagacagagcatcgtgcccctggaacacatcagggatctgcacgagtggctggacggcaagagaaaggccagacagtcctgtagactcgtgggcgagagcagaaccggaaagaccgtggcctgtgaagcctacacactgcggaacaagcccatccagcagggcagacagacacccattgtgcccgtggtgtacatcatgccacctaccaagtgcggcagcaaggacctgttcaaagagatcatcgagtacctgcggtacaaggccgtgaagggcaccgtgtccgagttcagatccagagccatggaagtgctgaagggctgcgaggtggaaatgatcatcatcgacgaggccgaccggctgaagcccgacacatttcctgatgtgcgggacatcaacgacaagctggaaatcagcgtggtgctcgtgggcaacgacagactggatgccgtgatcaagcgggacgaacaggtgtacaaccggttcagagcccacagaagattcggcaagctggccggcgtggaattcaagaaaacagtggccatctgggaagagaaggtgctgaagctgcccgtggccagcaatctgacaagcagcgccctgatcaagatcctggtcaaggccaccgagggctacatcggcagactggacgagattctgagagaggccgccatcaagagcctgatgaagggccacaagcggatcgagaaagaggtgctgcaagaggtcgccaaagagtacagctga

SEQ ID NO: 1083 - DNA, 489 bp, Cyanothece species
atgaaggccaccgacgagatcaagccttggctgttcgccgtggaacctatcgagggcgagagcctgtctcacttcctgggcagagtgcggcggagaaaccacctgtctccatctgctctgggacagctggccggaatcggagccaaaattgccagatgggagcgcttccacctgaatccatttccaagcgacgccgacctgaaggccctgggagaaatcgttggagtggaaggcaagcggctgcggcttatgttgcctcctaagggcgaaagaatgatgttcgaccccatcagactgtgcggcgcctgttatggcgaagtgccctgtcacaagatcgagtggcagttcaagagcgtttggagatgcgagaagcacagcctgaagctgctgagcaagtgccccaactgccggaagaagttcaagatccccgctctgtgggagttcggcgagtgcgatagatgccggctgagcttccaagagatccggtga

SEQ ID NO: 1084 - DNA, 2013 bp, Cyanothece species
atgagcaccatcaccatccagtgcagactggtggcccctgaggctacaagacaggctctgtggcagctgatggcccagaaaaacacccctctggtgtccgagctgctgagacaggttgcccagcatcctgacttcgagacatggcggcagcagggaaaactggaagccggcatcatcaagaagctgtgcgagcccctgaagaaggaccccagattctacgagcagcccgccaggttttacaccagcgccattagcctggtggactacatctacaagagctggctgaaggtgcagcggcggctgcagaacaaactcgagggccagaatcggtggctggtcatgctgaagtccgacgaggaactggtgcagatcagccagagcagcctggaaaccattcaggccaaggccaccgacatcctgagcaccctgaagcctgagaagcccgacaagttccccgagacaagcaccaccaagggcaagaagtccaagaagtataagaacaacaacagcctgttcacccagctgtacaacctgtacgagaaggccgacgacaccctgacacactgcgccatcagatacctgctgaagaacggctgcaagatccctcagaagccagaggaccctgagaagttcgcccagcggagaagaaaggtggaaatcaagatcgagcggatcatcgagcagatcgagagcagcatccctcagggcagagatctgacaggcgacagctggctggaaaccctgatcattgccgccaataccgccaccgtggaagccagcgagatcaagtcctggcaggacaagctgctgtcccagagcaagagcatcccctatcctgtggcctacgagacaaacgaggacctgacctggtccatcaacgagaagggcagactgtgcgtgcggttcaatggcctgggcaagcacaccttccagatctactgcgaccagcggcagctgaagtggttccagaggttctacgaggatcagcagatcaagaaggacggcaaggaccaccacagcagcgccctgttttctctgagaagcggccggatcgtgtggcaagaaggcctcggaaagggcaagccctggaacatccacagactgaccctgcactgtagcctggacacccggttttggaccgaagagggcacacagcaggtccagcaagagaaaagcaagaagttccagaccaaccggctgcggatgaagcccgagctgaccttctccatcttcttcagatctcagaccctcgagacatacctgcaagtgtggctcgtgatcaccgcctacagactgcagagcttcctggacaagggcaacgtggcaaaggcccaccaagagtttcagaaggccatcaagcggaacgagtccagcctgcagaagatcaccagcagctacaacagaccccacaagaccctgtaccagggcaagtcccacatctttgtgggcgttgccatgggcctcgagaagcctgctacagtggctgtggtcgatggcaccacaggcaaggctatcgcctatcggagcctgaaacagctgctgggaaacaactaccacctgttcaacagacagggcaagcagaagcagaacacaagccaccagagacacaagagccagaagcacttcgccgacaaccagttcggcgagtctcagctgggccagtacatcgattgtctgctggccaaagccatcatcagcgtggcccagacatactgcgccggctctattgtggtgcccaagctgaaggacatgagagagctgatccagagcgagatccaggctaaggccgaggccaagattcccggctatgtggaaggacaggccaaatacgccaagagctacagagtgcaggtccaccagtggtcccacggcagactgatcgacaacatcacaagccaggccagcaagttcaacatcactgtggaagagggcgagcagcctcaccagggaaaccctcaggataaggccaaactgctggcaatcgccgcctaccactctaggctgtgtgcttga

SEQ ID NO: 1085 - DNA, 520 bp, Cyanothece species
agctcaaatattgcaccttgaaaattaaatacgttaggattggtattaatcgcgccgtagttcatgttcttttgaaccaatgtgctgcgctaagtatgggttagtttgcctgttggttaaacaggtgtgctttctggccctggtgactgctcgccctgatgctgatttctacacttcataggcgtaggaatgattaactcgtaagttgatgttaaatgctactttaattttacggggtcggtgcgctcccagcaataggggtgtggacatacctcagtagttgtcactgaatcacctccgagcaaggaggaatccatccttatttttcctttttgacgggggaaagcgagggcaaaatccctggagtcccgtcagaatcctgaaagtcttacctagacttgattatagagtttattgtggatggtcatgccagattctacaagttgtaaaacatcatattttggagacccatcagaattgtttctaaaattgagtgttaaaaaggcttttagctgacgga

SEQ ID NO: 1086 - DNA, 37 bp, Cyanothece species
gtttcaacgaccattcccaacagggatgggttgaaag

SEQ ID NO: 1087 - DNA, 572 bp, Cyanothece species
  misc_feature (549)..(572): n is a, c, g, or t
agctcaaatattgcaccttgaaaattaaatacgttaggattggtattaatcgcgccgtagttcatgttcttttgaaccaatgtgctgcgctaagtatgggttagtttgcctgttggttaaacaggtgtgctttctggccctggtgactgctcgccctgatgctgatttctacacttcataggcgtaggaatgattaactcgtaagttgatgttaaatgctactttaattttacggggtcggtgcgctcccagcaataggggtgtggacatacctcagtagttgtcactgaatcacctccgagcaaggaggaatccatccttatttttcctttttgacgggggaaagcgagggcaaaatccctggagtcccgtcagaatcctgaaagtcttacctagacttgattatagagtttattgtggatggtcatgccagattctacaagttgtaaaacatcatattttggagacccatcagaattgtttctaaaattgagtgttaaaaaggcttttagctgacggagaaattcccaacagggatgggttgaaagnnnnnnnnnnnnnnnnnnnnnnnn

SEQ ID NO: 1088 - DNA, 500 bp, Cyanothece species; identical to SEQ ID NO: 814

SEQ ID NO: 1089 - DNA, 500 bp, Cyanothece species; identical to SEQ ID NO: 815

SEQ ID NO: 1090 - DNA, 1887 bp, Calothrix species
atgtccgtgtttgccctgatggccgacaagaagttcgagctgaccgagaagttcacccagctgcctgaggccgtgtttctgggcgagaacaacttcgtgatcgaccccagccagatcatcctggaaaccagcgacaagcacaagctgaccttcaacctgatgcagtggctggccgagtctcccaacagaaccatcaagagccagcggaagcaggccattgcctctacactgggcgtgtccaccagacaggtggaaagactgctgaagcagtacgacgaggaccggctgtctgagacatctggcctgcagagaagcgacaagggcaagtacagagtgtccgactactggcaagagttcatcaagaccacctacgagaagtccctgaaggacaagcaccctatcagccccgcctctatcgtgcgggaagtgaagagacacgccatcgtggacctgaagctggaacagggcaactaccctcatcctgccaccgtgtaccggatcctgaatcctctgatcgagcagcaagagcggaagaaaaaagtgcggaaccctggcagcggcagctggatgacagtggaaacaagagatggcaagcagctgaaggtggacttcagcaaccagatcattcagtgcgaccacaccaagctggacatccggatcgtggatagcgacggcatcctgctgaccgaaagaccttggctgaccaccgtggtggataccttctccagctgcgtgaacggctttcacctgtggatcaagcagcctggctctgccgaagtggctatcgccctgagacatgccatcctgcctaagcagtaccccgacgattacgagctgggcaagccctggaagatctacggacaccccttccagtactttttcaccgacggcggcaaggacttcagatccaagcacctgaaagccatcggcaagaaactgggcttccagtgcgagctgagagacagacctatccaaggcggcatcgtggaacggatcttcaacaccatcaacacccaggtgctgaaggacctgcctggctacacaggccccaatgtgcaagagaggcctgagaacgccgagaaagaggcctgtctgtccatccacgacctggacaagatcctggccagcttcttctgcgacatctacaaccacgagccttatcctaaggacacccggatcaccagattcgagcggtggttcaaaggcatgggagagaagctgcccgagcctctgaatgagagagagctggatatctgcctgatgaaggaagctcagagagtcgttcaggcccacggcagcatccagttcgagaacctggtgtacagaggcgagagcctgaatgcccacaagggcgagtatgtgaccctgagatacgaccccgaccacatcctgacactgtacgtgtacagctacgacgtgaacgacgagctggaaaacttcctgggctacgtgcacgccatcaacatggacacacaggacctgagcctggaagaactgaagtctctgaacaaagagcggagcaaggccagaagagagcacagcaattacgacgccctgctggccctgagcaagcggaaagaactggtggaagagagaaagcagggcaagaaagagaagcggcaggccgagcagaagagactgagagccgccagcaagaaaaacagcaacgtggtggaactgcggcagaacagagccagcagcagctccaacaaggacgagaaggatgagaagatcgaactgctgccagagcgggtgtcccgcgaggaactgaaagtggaaaagatcgagcctcagctggaaatcctggataaggccgagacacctcctcaagagcggcacaagctcgtgatcagcagcagaaagcagcacctcaaaaagatctggtga

SEQ ID NO: 1091 - DNA, 852 bp, Calothrix species
atggccagatctcagctggccatccagagcagcgtggaagtgctggttcctcagctggacctgaatgcccagctggctaaggtggtggaagtggaagagatcttcagcaactacttcatccccaccgacagaagcagcgagtacctgagatggctggacgagctgcggatcctgagacagtgtggcagagtgatcggccccagagatgtgggcaagtctagagccagcctgcactaccagggccaagaccagaaacggatcagctacgtcagagcttggagcgccagcagcagcaagagactgttcagccagatcctgaaggacatcaagcacgccgctcctatgggcaagcgcgacgatcttagacctagactggccggctctctggaagtgttcggcttcgagcaagtgatcatcgacaacgccgagaacctgcagaaagaggccctgctggatctgaagcagctgttcgacgagtgccacgtgccaatcgtgctgatcggaggccaagagctggacaccatcctggacgagttcgacctgctgacctgctttcccacactgtacgagtttgacggcctggatgagaacgacttcaagaaaaccctgaacaccatcgagttcgatatcctggctctgcccgaggccagcaatctgtctgagggcatcatcttcgagctgctggccgagtctacaggcgccagaattggcctgctggtcaagatcctgacaaaggccgtgctgcacagcctgaagaacggcttctccaagatcgaccagaacatcctggaaaagatcgccaacagatacggcagacggtacatccctcctgagaagcggaacaacaagtga

SEQ ID NO: 1092 - DNA, 567 bp, Calothrix species
atggccgaggacatctacctgcctaagagagagatcatcagcaacaaagagatcaacaagggcgacgagatcctgcctagactgggcttcgtggaaccctacgagtgcgagagcatcagccactacctgggcagagtgcggagattcaaggccaacagcctgcctagcggctacagcctgggaaagatcgccggaattggcgccgtgaccaccagatgggagaagctgtacctgaatccatttcctagcgagacagagctggaagccctggccaaagtgatcgaggtggaagtggaacggctgcggcaaatgctgcctcctaagggcatgaccatgaagcccagacctatcagactgtgcgccgcctgttatgccgagtctccccaccacagaatcgagtggcagttcaaggacgtgatggtctgcgacagacaccagctgcctctgagcaccaagtgcaagaattgcggcaccccttttccaatacctgccgattgggttcgaggcgagtgccctcactgctgcctgagctttaccaagatggccaagcggcagaagtccggctaa

SEQ ID NO: 1093 - DNA, 1920 bp, Calothrix species
atgagcgtgatcaccatccagtgcagactggtggccgacgaagagacactgagacacctgtggacactgatggccgagaaaaacacccctttcgccaacgagatcctggaacagctggcccagcacgccgagtttgagagctgggtcaagaacagcagagtgcccgccaccgtgatcaaagagctgtgcgacagcctgaagaatcaagagctgttcgccggccagccaggcagattctacacaagcgccacaacactggtcacctacatctacaagagctggctggctgtgaacaagcggctgcagagaaagatcgagggcaagaaacagtggctggacatgctgagaagcgacaccgagctggaacaagagagcaacagcaacctggaaaagatcagagccaaggccaccgagattctggatagcttcgccaccagacagatcaatcaagtgaacagcaagagcaagacctctaagaacaacaaaaacaagcaagagaaagaagtgaagtccctgagcatccagagcaacatcctgttcgagacataccggcagaccgaggacaacctgaccaagtgcgccatcgtgtacctgctgaagaacaactgcgaagtgaacgacgtggaagaggacatcgaggaatacgagaagaacaagcgcaagaaagagatccagatcaagcggctcgaggaccagctgaagtccagagtgcctaagggcagagatctgaccggcgagaaatgggtcgaagtgctggaaaaggccgtgaacagcgtgcccgagtctgagaatgaggccaagtcttggcaggccagcctgctgagaaagtcctctcagatcccatttcctgtggtgtacgagacaaacgaggacatcaagtggtccatcaacgagaaaggccggatcttcgtgtccttcaacggcctgggcaagctgaagttcgagatcttctgcgacaagcggcatctgcactacttccagcggtttctggaagatcaggacattaagcggcaggggaagaaccagcacagcagcagcctgttcaccctgagatccggcagaatctcttggctcgagcagcctggcaagggcaagccctggaacatcaatagactgctgcttttctgcagcatcgacacccggatgctgacagccgagggaacccagcaagtgatcgaagagaagatcgccgacacacagaacaagatcgccaaggctcaagagaagtgcgagggcgagctgaaccctaatcagcaggcccacatcaaccggaagaagtccacactggcccggatcaacaccccatttccaagacctagcaagcccctgtaccagggcaagagccatatcgttgtgggcgtgtccctgggcctgaaagccacagctacaatcgccgtgttcgacgccatgaacaaccaggtgctggcctacagaagcaccaaacagctgctgggcgacaactacaagctgctgaaccggcagcagcaacagaagcagagactgagccagcagcggcacaagagccagaagcagttcgccagcaatagcttcggcgagagcgaactgggccagtacgttgacagactgctggccaaagaaatcgtggccgtggccaagaatttcggagccggcagtatcgtgctgcccaagctgggagacatgagagagatcatccagtccgaggtgcaggccaaggccgagaagaagatccctggcttcattgagctgcagaagaactacgccaaagagtacagaaagagcgcccacaattggagctacggccggctgatcgagaatatccagtctcaggccaccaaagaggggatcgagatcgagacaggcaagcagcccacacggggaatcccacaagaacaggctagagatctggccctgtttgcctaccagtgccggattgcttga

SEQ ID NO: 1094 - DNA, 587 bp, Calothrix species
tgaaattaaataaaatacagaaccttgaaaacttaatatgaaataaatagcgccgcagttcatactctttgagccaatgtactgcgataaatctgggttagtttgacggttggaaaaccgtcttgctttctgaccctggtagctgcccgctcttgatgctgctgtctgctttgactagacaggatatgccttttttgcaatttagttggataaacagttttttatgtttttagcgacagtgaaaaacttttatacaagtatatcaaatagggacaggtgcgctcccagcaataaagagtacagatgcaaatctggagccgttttattacggtggggattacctcagcggtggttactgaatcacccccttcgtcgggggaaccctctcaaatctttttttggcgcgtcgaagcgggggcaaaatccctggactcccgccaaaatctcaaaactcttgccctgtattaatttgaaggaactgagtatcaattgatttagttttttcattttcaagtggagatgcttttaggtagtcctgacaaatgtgcagtttaaaagcttcaatagtaagggtttcagacggtcgg

SEQ ID NO: 1095 - DNA, 37 bp, Calothrix species; identical to SEQ ID NO: 813

SEQ ID NO: 1096 - DNA, 639 bp, Calothrix species
  misc_feature (616)..(639): n is a, c, g, or t
tgaaattaaataaaatacagaaccttgaaaacttaatatgaaataaatagcgccgcagttcatactctttgagccaatgtactgcgataaatctgggttagtttgacggttggaaaaccgtcttgctttctgaccctggtagctgcccgctcttgatgctgctgtctgctttgactagacaggatatgccttttttgcaatttagttggataaacagttttttatgtttttagcgacagtgaaaaacttttatacaagtatatcaaatagggacaggtgcgctcccagcaataaagagtacagatgcaaatctggagccgttttattacggtggggattacctcagcggtggttactgaatcacccccttcgtcgggggaaccctctcaaatctttttttggcgcgtcgaagcgggggcaaaatccctggactcccgccaaaatctcaaaactcttgccctgtattaatttgaaggaactgagtatcaattgatttagttttttcattttcaagtggagatgcttttaggtagtcctgacaaatgtgcagtttaaaagcttcaatagtaagggtttcagacggtcgggaaatcccgactaggggtgggttgaaagnnnnnnnnnnnnnnnnnnnnnnnn

SEQ ID NO: 1097 - DNA, 500 bp, Calothrix species; identical to SEQ ID NO: 817

SEQ ID NO: 1098 - DNA, 500 bp, Calothrix species; identical to SEQ ID NO: 818

SEQ ID NO: 1099 - DNA, 1662 bp, Crinalium epipsammum
atggccaccgacaatcctaatgccagcggcatcgtgaccgagctgtctcacgaggccaagctgaagctggaaatcatcgagagcctgctggaaccctgcgacagacagacatacggcgagagactgaaggacgccgccaagaaactgggcaagtctgtgcggacagtgcagcggctggtgcagaaatgggaagccgaaggactgctggccctgaccggaacacagagagtggataagggcagacaccggatcagccaggactggcaggacttcatcatcaagacctaccgcgacggcaacaagggcagcaagcggatgagcagaaaacaggtggccctgagagtggaagtgcgggccaaagaactgggcgacgaggactaccccaactaccggacagtgtacagagtgctgcagcccctgattgaggcccaagaacagaaaaaaggcgtgcggacacctggctggcgaggctctcaactgagcgtgaaaaccagaaccggcgacgacatcagcgtggaatactccaaccacgtgtggcagtgcgaccacacatgggttgacgtgctggtggtggatatcgagggcgagatcatcggcagaccttggctgaccaccgtgatcgacacctacagcagatgcatcctgggcatcagagtgggcttcgatgcccctagttctcagctggttgccctggctctgagacacgccatgctgcccaagaattacggcaccgagtacgagctgcactgccagtggggcacatatggcaagcccgagtacctgtttaccgacggcggcaaggacttcagaagcgagcacctgaagcagatcggcgtgcagctgggcttcacctgtatcctgagagacagacctagcgaaggcggcgtggtggaaagacctttcggcaccctgaacaccgaactgtttgccggcctgcctggctacgtgggctctaacgttcagcagaggcctgagcaggccgagaaagaggcttgtctgaccctgcctgagctggaaaagcggatcgtgcggtacatcgtggacaactacaaccagcggatcgacaagagaatgggcgaccagaccagataccagagatgggaggctggcctgctggccacacctgatctgatcggagagagagatctggacatctgcctgatgaagcagaccaaccggtccatctacagagagggctacatcagattcgagaacctcatgtaccagggcgaacacctggccggatatgccggcgaaagagtggtgctgagatacgaccccagagacatcacctctgtgctggtgtaccagcctcagaaagacaaagaggtgttcctggccagagcctacgccacaggactggaagctgaacaggtgtccctcgaggaagtgaaggccagcaaccagaagatcagagagaagggcaagaccatcagcaaccacagcatcctggaagaagtccgcgaccgggatatcttcgtggccaagaaaaagaccaagaaagagcgccagaaagaggaacagaagcagctgcacagcgccgtgtccaagtctcagcctgtggaagtggaacccgagcctgagatcgaggatacccctgtgcctaagaaaaagccccgggtgctgaactacgatcagctgaaagaggactacggctggtaa

SEQ ID NO: 1100 - DNA, 837 bp, Crinalium epipsammum
atggccgagaacaaggcccagtctgtggctgagcagctgggcgagatcaagagcctggatgccaaactgcaggccgagatcgagagactgagaggcaagaccctgctggaactggaacaggtgtccaagctgcacgactggctggaaggcaagcggagaagcagacagagctgtagagtcgtgggcgagagcagaaccggaaagaccgtggcctgcgacagctacagactgagacacagacccatccaagaagtgggcaagcctcctatcgtgcccgtggtgtatatccagcctcctcaagagtgtagcagcggcgagctgttcagagtgatcatcgagcacctgaagtacaacatggtcaagggcaccgtgggcgaaatccgcagcagaacactgcaggtcctgaagagatgcggcgtggaaatgctgatcattgacgaggccgaccggctgaagcctaagacctttgctgacgtgcgggacatcttcgacaacctgggcatctctgtggtgctcgtgggcaccgatagactggacaccgtgatcaagcgggacgagcaggtctacaaccggttcagagccagctaccacttcggccagctgaagggcaacaagttcaaagagacagtcgagatctgggagcaagacgtgctgagactgcccgtgcctagcaacctgggaagcaagcccatgctgaagatcctgggagaagccaccggcggctatatcggcctgatggacatgatcctgagagaggccggaatcagagccctcgagcagggcctgaccaagatcgacagagacaccctgaaagaggtggcccaagagtacaagtga

SEQ ID NO: 1101 - DNA, 501 bp, Crinalium epipsammum
atggacgagatccagccttggctgttcgctatcgctcctctggaaggcgagagcctgtctcacttcctgggcagattcagaagagagaacgacctgagcgcctccatgctgggaaaagaggccggaattggagccgtggtggccagatgggagaagttccacctgaatccatttccaagccggaaagagctggaagccctggccaaagtggtgcaggtcgacagcgatcggctgagagaaatgctgcctcctgaaggcgtgggcatgaagcacgagcctatcagactgtgcggcagctgctatgcccagtctccttgccacaagatcgagtggcagttcaagaccacacagagatgcgaccggcacaagctgacactgctgagcgagtgccctaactgcaaggccagattcaagatccccgctctgtgggccgatggctggtgccacagatgctttaccaccttcgccgagatgagcaagagccacaaagaactcgtgtga

SEQ ID NO: 1102 - DNA, 1845 bp, Crinalium epipsammum
atgagccagatcaccgtgcagtgtagactggtggccagcgagagcacaagacaccacctgtggaagctgatggccgacctgaacacccctctgatcaatgagctgctggccagaatggcccagcaccaggattttgagacatggcggaagaagggcaagctgcccgacggaattgtgaagcagctgtaccagcctctgaaaacagaccccagattcaccaaccagcctggccggttttacaccagcgccatcaccgtggtggactacatctacaagagctggttcaagatccagcagcggctggaacagaagctgaagggccagatcagatggctgggcatgctgaagtccgacgaagaactggccgccgagagcaacaccagcatcgaagtgatcaggaccaacgccgccgagctgatcacaagcctgtctagcgaggatggcagcgtgtccaccagactgtggaaaacctacgacgagacagacgacatcctgacacactgcgtgatctgctacctgctgaagaacggcagcaaggtgcccaagaagcccgaggaaaacctggaaaagttcgccaagcggcggagaaaggtggaaatcaagatcgagcggctgcggcggcagctggaaagcagaattcctaagggcagagatctgaccggcaagaattggctggaaaccctggccattgccagcacaacagcccctgccgatgaacctgaagctcagtcctggcaggataccctgctgaccgagtctaagctggtgccctttccagtggcctacgagacaaacgagaatctgacctggtccaagaacgagaagggcagactgtgcgtgcagatcagcggcctgagcaagcacatcttccagatctactgcgaccagagacagctgaagtggttccagcggttctacgaggaccaagagatcaagaaggccaacaaggaccagtacagctccggcctgttcaccctgagatctggcagaatcgcctggcaagagggcaccgataagggcgagccttggaacatccaccacctgatcctgtactgcaccgtggacacaaggctgtggacagccgagggaacagagcaagtgtgccaagagaaggccgaagatatcgccaagacactgacccggatgaagaagaaaggcgatctgaacgaccggcagcaggccttcattcggagacagcagagcacactggcccggctgaacaacccctatcctagacctagccagccactgtaccagggccagcctcacattcttgtcggcctggcctttggcctggacaaacctgctacagccgccgtggttgatggcacaacaggcaaggccatcacctaccgcagcctgaaacagctgctgggcgacaactacgagctgctgaacaagcagcggaagcggaagcagcagcagtctcaccagaggcacaaggcccagagcaacggcagaagcaaccagttcggcgatagcgacctgggcgagtacgttgacagactgctggctaaggccctcgtgacactggctcagtcttatcaggccggctccatcgtgctgcctaagctgggagatatcagagagctgatccagagcgagattcaggccaaggccgagcagaagatccccggctatattgccggacaagagaagtacgccaagcagtacaagatctccgtgcaccagtggtcttacggccggctgatcgacaacattaaggcccaggccgccaaaatcagcatcgtgatcgaggaaggacagcagcccatcagaggcagccctcaagagaaagccaaagagatggccattagcgcctacgatgaccggaccaagtcctga

SEQ ID NO: 1103 - DNA, 515 bp, Crinalium epipsammum
aactaatctaaattctgtaccttgacaatagaatagaattatcaatagcgccacaggtcatgttcaatagaacctctgaactgtgaaaagtgtgggttagtttaactgtcggcagacagttgtgctttctgaccctagtagctgtccactcggatgctgatatctacggtttcggctgtaggaatgattaacctgtaagttgaagtacactgatacttcaattttatggggtaggtgcgctcccagcaataagagtgtgggtttactacagtgatggctactgaatcacctccgagcaagggggaatccaccctaatttttctttttcgtgaacccaagcggggtcaaaattcctgggaggtttacgaaaactgtaaatcccttatcaaatattgagttcagtatttttgtgggatggttgctcctgtaaatacaggagatagaaagcgaaaattttagaggtttacgaaaatcgcctctaaaagctcctccaggtaactgttgtagcgatcgct

SEQ ID NO: 1104 - DNA, 37 bp, Crinalium epipsammum; identical to SEQ ID NO: 816

SEQ ID NO: 1105 - DNA, 567 bp, Crinalium epipsammum
  misc_feature (544)..(567): n is a, c, g, or t
aactaatctaaattctgtaccttgacaatagaatagaattatcaatagcgccacaggtcatgttcaatagaacctctgaactgtgaaaagtgtgggttagtttaactgtcggcagacagttgtgctttctgaccctagtagctgtccactcggatgctgatatctacggtttcggctgtaggaatgattaacctgtaagttgaagtacactgatacttcaattttatggggtaggtgcgctcccagcaataagagtgtgggtttactacagtgatggctactgaatcacctccgagcaagggggaatccaccctaatttttctttttcgtgaacccaagcggggtcaaaattcctgggaggtttacgaaaactgtaaatcccttatcaaatattgagttcagtatttttgtgggatggttgctcctgtaaatacaggagatagaaagcgaaaattttagaggtttacgaaaatcgcctctaaaagctcctccaggtaactgttgtagcgatcgctgaaatcccaactaggggtgggttgaaagnnnnnnnnnnnnnnnnnnnnnnnn

SEQ ID NO: 1106 - DNA, 500 bp, Crinalium epipsammum
ccgtactgagtctattcgttgactcgagaggatctaaacgagatcaatttttcacaaagacacataatttgactccacaacaaataatgtgtcagtgtacatgtcgattgccaaattatatgtcgtcttgtcaaattaattgacatgataaattttaagcctgtaatcctcacgaatcatagattacaggctattttagcatctttcacttcattgaatactaattgacaaattaaatgtcttatcttgggaaattgacaaattaaatgtccaagtttggaaattaagatttttatcatctttgacagattgtttgtcattaccagtataattgtactatgttgcaattaaacagtaatgttggaatatggcgacagataaccctaatgcctctggaattgtgaccgaactctcgcatgaggcgaaactgaagctagaaattattgagagtttgctggaaccgtgcgatcgccaaacctacggggaacgtctcaaagatg

SEQ ID NO: 1107 - DNA, 500 bp, Crinalium epipsammum
tagatgcccagtcgccatttaatttgaagcctgggtttcaactaccatcccaactaggggtgggttgaaagttacctttaggcaagcaaatttttctaaagcgatcagttagacactctgaaaaattacaaatgataggatggattgaaaggagcatcggactcttaactttgtatgtaagattgcagctaattgtccaatggctgttagaaagagacgcttaatttgtcactgttatttaaaagacactaatttgtcaaaacgacattaatttgacaacgacgacaaataatgtggcaatcgacaacaagatgggtaaccaggggctcgaaccctgaaccaacggattaagagtccgatgctctaccattgagctagtcacccttagaaaaactattataacagattttaataaattaagtaaactatttactaaaaatttttgattaaccgatcgctaatttattcgggatactatacatatcatgctcccgatttgc

SEQ ID NO: 1108 - DNA, 1797 bp, Microcoleus species
atgagccaggacagccagagattcttcagccctcacgagggcaacaagcccaccgagctgcagagaaccagcaagaaccctgccaagagccacagactgcctagcgacgagctgatcaccgatgaagtgcggctgcggatggaaatcatccagagactgaccgagccttgcgacagaaagacctacggcatccggaagagagaggccgccgaaaagctgggagtgaccctgagatccatcgagcggctgctgaagaagtaccaagagcagggactcgtgggcctgacacagaccagatctgacaagggccagagaagaatcagcgccgactggcaagagttcatcgtcaagacctacaaagagggaaacaagggcagcaagcggatgctgcggaaccaggtgttcctgagagtgaagggcagagccaagcagctgggcctgaagcctgaggaataccctagccaccagaccgtgtaccggatcctggacgagtacatcgagggcaaagagcggaagcggaacgccagatctcctggctatctgggcagcagactgacccacatgaccagagatggccaagagctggaagtggaaggcagcaacgatgtgtggcagtgcgaccacaccagactggacatcagaatcgtggatgagtacggcgtgctggacagaccttggctgaccgtgatcatcgacagctacagcagatgcctgatgggcttcttcctgggctttttcgcccctagcagccagatcgatgccctggctctgagacacgccatcctgcctaagttctacggcagcgagtatggcctgggcgacaaagagtttggcacctacggaatccccagctacttctacaccgacggcggcaacgacttccagagcatccacatcacagaacaggtggccgtgcagctgggattctcttgtgccctgagaagaaggccaagcgacggcggaattgtggaacggttcttcaagaccctgaacgaccaggtgctgagaaacctgcctggctacaccggctccaatgtgcaagaaagacccgacgacgtggacaaggacgcctgtctgacactgaaggacctggatatcatcctcgtgcggtacatggtcaaagagtacaacggccacaccgacgccagattcatcgtgaaagagtataacgccgacgacaccgacgtgaagctgaacgcccagacacggttcatgagatgggaggccggactgatgatcgagcctcctctgtacgatgagctggacctcgtgatcgccctgatgaaggccgagagaaggaccgtgggcaaatacggcaccctgcagtttgagagcctgacctacagagccgagcacctgagaggcagagaaggcaaagtggtggccctgagatacgaccccgacgacatcaccaccatcttcgtgtatcagatccacgaggacggcaccgaggaatttctggactacgcccatgctcagggcctcgaggtggaaagactgagcctgagagagctgcaggccatcaagaagcggctgagagaagcccgggaagagatcaacagcgagacaatccaggccatgctggaacgggaagagtggaccgaggaaaccatcaagcggaaccggcagcagcggagaaaagccgctcacgagctggtcaatcctgtgcagagcgtggccgagaagttcggcatcgtggaacctcaagaggccgactctgaggccgaggaagaactggaagccgagctgcctagatacaaggtgcagtacatggacgagctgttcgacgacgactga

SEQ ID NO: 1109 - DNA, 723 bp, Microcoleus species
atgccctaccacatctggatgtacgagctgctgctgagcagaatgaccggcctgctgctgggcgagtctagatctggcaagaccgtgacctgcaagaccttcaccaaccggtgcaaccagcaggccaagaccaaggacaagcgcgtgatgcccgtgatctacattcagatccccaagaactgcggcagccgggacctgttcatcaagatcctgaaagccctgggccacagagccaccagcggcacaattaccgacctgagagagagaaccctggacaccctggaactgtttcaggtgcagatgctgatcatcgacgaggccaaccacctgaagctggaaacctttagcgacgtgcggcacatctacgacgacgacaatctgggcctgagcgtgctgctcgtgggcaccacaaatagactgaccagagtggtggaacgggacgaacaggtggaaaaccggttcctggaaagataccagctggacaagatcaacgacaaagagttccagcagctggccaaaatctgggtgcaagacgtgctgggcatgagcgaggccagcaatctgatcaagggcgagacactgcggctgctgaagaaaaccaccaagcggctgatcggccggctggacatgattctgagaaaggccgccatcagaagcctgctgaagggctacgaaaccctggatgccgaggtgctgaaacaggtggccaagagcgtgaagtga

SEQ ID NO: 1110 - DNA, 546 bp, Microcoleus species
atggacgagctggaaacccagctgtggctgaacagagtggaaccctacgagggcgagagcatcagccactttctgggcagatttcggagagccaagggcaacaagttcagcgccccttctggcctgggaaaagtggcaggactgggcgtcgtgctcgtcagatgggagaagctgtacctgaatccatttccaaccaggcagcagctggaagccctggccgatgtggttatggtggacgccgatagactggcccagatgctgcctcctaagggcgtgaccatgaagcccagacctatcctgctgtgcgccgtgtgctatgccgagaatccctaccacagaatcgagtggcagttcaaagagagatggggctgcgacggcagaagcgccaatagactgagacacagacaccagctgcctctgctgggcaagtgcatcaactgcgagacaccctttcctatacctgctctgtgggtggaaggcgagtgccctcactgctttctgccctttgccagaatggccaagcggcagaagtccagaagggcctaa

SEQ ID NO: 1111 - DNA, 1914 bp, Microcoleus species
atgagcatcatcaccgtgcagtgccagctgaaggccaccaaggatagcctgagacacctgtggtccctgatggtggaaaagaacaccctgctggtcaacgagctgctgaagcagatcaacacacaccccgacctggaaaactggctgaaagtgggcaacatcaaggccgaagtgatcgagggcctgtgcgacaacctgagaaccgagagcagattccaggacatgcccggcagatttgccaacgccgccgagaagctggtcaaggacatctacaagagttggttcgccctgcaagaggaacggcggtttagactgtggcggaagcagagatggttcagcctgctgcggagcgatctggaactggaacaagagagcggcctgagcctggaaaagctgagaacagaggccacaaagatcctgatcaaggcccagctggaatgcagcagagaggccgaaccagatcaggccaccaccgataatagcagcgccctgtgggacaatctgttcaccgcctacgacaagttcaagagccccagactgagatgcgtgatcgcctacctgctgaagaacggctgccaagtgaacaaggtggaagaggaccctgaggcctaccagcggcgcagaagaaagaaagagatccagatcgagcggctgaaagagcagctgaagtccagactgcccaagggcagaaacctgagcgagcaagaatggctggaagccctggaacaggcccagggactgatcatcgacgacgagcatctgagacaggtgcaggccagcctgaccagaaagcagagcccagtgcctttcagcatcagctacgagacaagcaccgacctgcggtggtccagcaatgagcagggcagaatctgcgtgtccttcaacggcaagggcatcagcaagcacaccttcgaggtgttctgcgaccagcggcagctgcattggttcgagagattctacgaggactacaagatcttcacccagaacaaggaccaggtgccagccggactgctgacactgagatctgccagactcgtgtggcaagaaggcgaaggcgagggcgagccttggcaagttcatagactgctgctgcactgcagcgtggaaaccagactgtggacagcccagggcacagaagaagtgcgggccgagaaaatcgcccagacacaggccgccatcgacagacagaaagccaagggcacccagagcaagaagctgaacacaagcctggaacggctgaaaacctttcagggcttctcccggcctagccgggccagctataagggcaattgcagcatcgtgatcggagtgtccttcggcagagccaagcctgccacagtggccgtggtcaatgtggaaacaggcgaggtgctggcctaccgggatgtgaaacagctgctcaacaagcccatcaaagagggcaagaccaagaagaagaaaacccagtacgagtacctgaagcggagacaagagcagcagcgcctgaacagccaccagagacacaacgcccagaagaatggcgccccttgcaatttcggcgagagcaagcagggcgagtacgtggacagactgctggccaaggccattgtggaagtggccagccagtacagagccagctctatcgtgctgcccgacctgaggaatatcgaggaagccgccgaaagcgaagttcgggccagagccgagcagaagttccccggaaatcagaagctgcaggacagctacgccaaggactacagggccagcatccactgctggtcctactctagactggcccagtgcatcgagctgaaagccggaaaggccggaatcgccaccgagaaagtgcatcagcctcacggcgatacccctcaagagaaggccagagatctggtgctggctgcctacgccaacagaaaggtgtccgtgtcctga

SEQ ID NO: 1112 - DNA, 566 bp, Microcoleus species
gtaaacctttcctgaaccttgacaatataaataaacaatgttaattagttaacagcgccgctcgtacatgcttattgcctctgtacagtgctaagttagggtctgtttgactgtccggaaggcagttttactttctgagccctggtagctacccgcccgtaatgctgccccgatgacaccttcttcatcggtgggacaattcccgtatctgaataccgaagtatagagtatatgggaggtgcgctcccagctttcgtggtcgggctgagggaggaggtaaattttcccaaagccttagcccttgttaacaagggtgtggattaccacagtggtggctccgaactcgtccccttcgggggagccctccctaatatttttttgacggctgaaagcggggtcaaaatccctgagtagccgtcagtagttcaaaactcttgtccagtcttggttttaggctttcacgtcagtcaactttcttcttgggaaagagctgaaatgagcaatttaaaatcagccgtcaaaaatatatttgtcaggttgtgtagacaagggtttcagcgggcgcg

SEQ ID NO: 1113 - DNA, 37 bp, Microcoleus species
gtttcatcacccctcccgccttgggatgggttgaaag

SEQ ID NO: 1114 - DNA, 618 bp, Microcoleus species
  misc_feature (595)..(618): n is a, c, g, or t
gtaaacctttcctgaaccttgacaatataaataaacaatgttaattagttaacagcgccgctcgtacatgcttattgcctctgtacagtgctaagttagggtctgtttgactgtccggaaggcagttttactttctgagccctggtagctacccgcccgtaatgctgccccgatgacaccttcttcatcggtgggacaattcccgtatctgaataccgaagtatagagtatatgggaggtgcgctcccagctttcgtggtcgggctgagggaggaggtaaattttcccaaagccttagcccttgttaacaagggtgtggattaccacagtggtggctccgaactcgtccccttcgggggagccctccctaatatttttttgacggctgaaagcggggtcaaaatccctgagtagccgtcagtagttcaaaactcttgtccagtcttggttttaggctttcacgtcagtcaactttcttcttgggaaagagctgaaatgagcaatttaaaatcagccgtcaaaaatatatttgtcaggttgtgtagacaagggtttcagcgggcgcggaaatcccgccttgggatgggttgaaagnnnnnnnnnnnnnnnnnnnnnnnn

SEQ ID NO: 1115 - DNA, 500 bp, Microcoleus species
tactatacaaatacgttaaggtattaatctcccaaaagacacactataaaaaagacttctcagcgactgaacgctagaagccttccgttgatttattcttgtacattcacaaattaaatgtcgttatttaacaaattaatgtcgtagaaagattagcgcgtaatctacattctacaagggtttcagtgactttcaatcttaactaaggtgaacgtccgcatttaacattttatacgtcgcaatttagtacctttaacaatttatatgtcggttattggctaaaacttcaatttgaatcttaactagacttcacaaattgtttgtcgcattttagggcaagccagactatcatttggacagcggttagtacattggttctgtttgttgcttactgctcactctattatgtggaactctcgcatcacgtatgtaggtgaagaatgtctcaggattcacaacgttttttttctccgcatgaaggtaataagccaactgaactt

SEQ ID NO: 1116 - DNA, 500 bp, Microcoleus species
ttcatcacccctcccgccttgggatgggttgaaagtctgtgttaccttatttcctggaatttgtagggaaggttgaaaggcgcacttcgttcgggattattctgataggattaaatattctcaacacaatgagagggtaactttcttacttcattttccacgttcagaagtttagcgacaataatttgttaacagttgcctagaagcaaagtcgccgtaacagcgacgtgaatttgttaaaaacgacatcaatctgttaatagcgacatttaatttgtgaatgtacaacaattataatcgggatgacaggatttgaacctgcgaccccttcgtcccgaacgaagtgcgctaccaagctgcgctacatcccgataagttatagccgtaactcatctatggtatcacattgtatcggcaatcagccgccagcttgctaggataatcactgtaacttcagtgggagctgggctgggagtggtcgttaaaccagaatggttgcg

SEQ ID NO: 1117 - DNA, 1710 bp, Anabaena cylindrica
atgtacatgcggaacgagacacccctgacacctggcaacctgggagatgagagcagcatcggcaaagaaacccaggtgctggtgtctgagctgagcggagaggccaagctgaagatggaagtgatccagagcctgctggaagccggcgacagaacaacatacgcccagagactgaaagaggccgccgtcaagctgggaaagtctgtgcggacagtgcggcggctgatcgacaagtgggaagaagagggactcgtcggcctgacacagaccgagagagtggataagggcaagcacagagtggacgagaactggcaagagttcatcctcaagacctacaaagagggcaacaaaggcggcaagcggatgagcagacagcaggtcgccgtcagagtgaaagtgcgggctgatgatctgggcgtgaagcctcctagccacatgaccgtgtaccggatcctggaacctgtgatcgagaagcaagagaaggccaagagcatcagaagccccggctggcgaggaagcagactgagcgtcaagaccagagatggcaaggatctgcaggtcgagtacagcaatcaagtgtggcagtgcgaccacaccagagccgatgtgctgctggtggataagcacggcgagatccttggcagaccttggctgaccaccgtgatcgacagctacagcagatgcatcgtgggcatcaacctgggctacgatgcccctagttctcaggtggtggctctggccctgagacacgccattctgcctaagcagtacggccaagagtacgagctgtacgaggaatggggcacctacggcaagcccgagcacttttacacagacggcggcaaggacttcagaagcaaccatctgcagcagatcggcgtgcagctgggctttgcctgtcacctgagagacagacctagcgaaggcggcatcgtggaaagacccttcaagaccttcaacacccagctgttcagcacactgcagggctacaccggcagcaacgtgcaagaaagacctgaggaagccgagaaagaagcctgtctgaccctgagagagctggaacagagactggtggcctacatcgtgaacacctacaaccagcgcgaggacgccagaatgggcgatcagaccagatttcagagatgggacagcggcctgatcgtggcccctgaagtgatcagcgagagagatctggacatctgcctgatgaagcagagccggcggatgattcagagaggcggctacctgcagttcgagaacctgatgtacaagggcgagcacctggccggatatgccggcgaatctgtggtgctgagatacgaccccagagacatcaccaccatcctggtgtactcccacaagggccacaaagaggaatttctggccagggcctacgctcaggacctggaaacagaggaactgagcctggatgaggccaaggccatgatcagacggattagagaggccggcaagaccatcagcaaccggtctatgctggccgaagtgcgggacagagaaaccttcgtgaagcagaaaaagaccaagaaagagcggcagaaagaggaacaggccgtcgtccagaaaacaaaaaagcccgtgcctgtggaacccgtggaagagatcgaggtggccttcgtggaatccagccaagaaaccgacatgcccgaggtgttcgactacgagcagatgagagaagattacggctggtga

SEQ ID NO: 1118 - DNA, 1593 bp, Anabaena cylindrica
atggaactggtcgaggaagtgaacaagatcgtcggcatcaagaccaaagagacactgaccccaggccaggtggtcaaggccatgatcctgaatggcctgggctttctgagcgcccctctgtacctgttcggcgagttctttgtgggcaaagccaccgagcacctgatcggagaaggcgtgctgcccgaacacctgaacgatgacaagctgggcagagagctggacaagtaccaccagatcggcaccaccaagatcttcaccgccgtggccattaaggccgctcacaagttccaggtggaaatggacagcattcacctggacggcaccagcatgtctgtggaaggcgagtacaagaaagagatcaaagagattgacgagatcaagcaagagacagaggaaaacaagctggaaatcgagcccgagatgaaggccatcgagatcgtgcacggctacagcagagacaagaggcccgacctgaagcagttcatcatcgacatgatcgtgaccggcgacggcgacatcccactgtatctgaaagtggacagcggcaacgtggacgacaagagcgtgttcgtggaacggctgaaagaattcaagaagcagtggaccttcgagggcatcagcgtggccgatagcgctctgtacacagccgaaaatctggccgccatgcgcgagctgaagtggatcacaagagtgcccctgagcatcaaagaggccaagaacaagattgtggatatcaaagaagccgagtggaaggacagccagatcagcggctataagatcgccgccaaagagagcgagtacgccggaatcaagcagcggtggatcatcgtggaaagcgagatccggaagaagtccagcatccagcaggtcgagaagcaagtgaagaagcaagaagccaaggccaaggctgccctgagcaagctgagcagacaagagttcgcctgccagcctgacgccaagatcgtgatcgagaagctgtccaagtcctggaaatatcaccaaatcaaagaaatcgagtacattgagaagctcgagtataagaccgccggcagaccctccaagctgacagagcctagccagattaagtaccagatcaagggccagatcgagacacgggaagaagtgatcgaaaccgagaagatcaatgccggcagattcatcctggccaccaacgtgctggaccggaatgagctgtccgacgagaaggtgctggaagagtacaaggcccagcagagcaacgagcggggcttcagattcctgaaggaccctctgttcttcaccagctccgtgtttgtgaaaacccctgagagagtggaagccattgccatgattatgggcctgtgcctgctggtgtacaatctggcccagcggaagctgagacaagaactggccaagttcgacgacggcatccgcaatcaagtcaagaagatcaccaacaagcccaccatgagatgggtgttccagatgttccaggccgtgcacctggtcatcatcaacggccagaaacagatgagcaacctgaccgaggaacgcgagaagattgtgcgctacctgggcaagtcctgcagcaagtactacctgatcacctga

SEQ ID NO: 1119 - DNA, 504 bp, Anabaena cylindrica
atggaagtgggcgagatcaacccatggctgttccaggtggaaccctacctgggcgagagcctgtctcacttcctgggcagattcagacgggccaacgatctgaccacaaccggcctgggaaaagccgctggtgttggcggagccatcagcagatgggagaagttccggttcaaccctccacctagccggcagcaactggaagccctggccaaagtcgtgggagtcgatgccgatagactggaacagatgctgcctcctgctggcgtgggcatgaacctggaacctatcagactgtgcgccgcctgctacgtggaaagcccttgtcacagaatcgagtggcagttcaaagtgacccagggctgccagcaccaccacctgtctctgctgagcgagtgccctaattgcggcgccagattcaaggtgccagctctgtgggttgacggctggtgccagagatgcttcctgcctttcggcgagatgatcgagcaccagaagcggatctga

SEQ ID NO: 1120 - DNA, 1908 bp, Anabaena cylindrica
atgagccagatcaccatccagtgcagactggtggccagcgagacaaccagacagcagctgtggcagctgatggccgagaagaacacccctctgatcaacgagctgctcagccagatcggcaagcaccccgagttcgagacttggagacagaagggaaagcaccccaccggcatcgtgaaagagctgtgcgagcccctgaaaacagaccccagattcatcggccagcctgccagattctacaccagcgctaccgccagcgtgaactacatctacgagagttggttcgccctgatgaagagataccagagccagctggacggcaagctgcggtggctggaaatgttcaatagcgacgccgagctggtggaacactctggcgttagcctggataccctgagagccacctctgccgaaattctggcccagttcgcccctcaagacaccaacagagacaccagcaacaagggcaagaaaagcaagatgggcaagaagtcccagaagtccgacagcgagggcaacctgagcaagaagctgttcgacgcctacagcagcgccgaggacaatctgaccagatgcgccatcagccatctgctgaagaacggctgcaaggtgtccaacaaagaggaaaacagcgagaagttcacccagcggcggagaaagctggaaatccagatccagcggctgaccgagaagctggccgccagaattcctaagggcagagatctgaccgacacacagtggctcgaaaccctgttcaccgccacctacaacgtgcccgaggatgagacagaggccaaactgtggcagaacagcctgctgcggaagttcagcagcctgccttttccagtggcctacgagacaaacgaggacctcgtgtggtccaagaacagattcggcaggatctgcctgacattccccacactgagagagcacatcttccagatctactgcgacagccggcagctgcactggttccagagatttctcgaggaccaagagatcaagaagaacagcaagaatcagcactctagcgccctgtttaccctgcggagcggaagaatcgcttggcaagaaggcgaaggcaagggcgagccttgggacattcaccacctgacactgtactgctgcgtggacaccagactgtggaccgaagagggcaccaacctggtcaaagaagagaaggccgaggaaatcgccaagaccatcacacagaccaaggccaaaggcgacctgaacgacaaacagcaggcccacctgaagagaaagaacagctccctggccagaatcaacaacccatttcctagacctagccagcctctgtacaagggccagagccatatcctgctgggagtgtctctgggactcgagaagcctgctacagtggccgtggtggatggcacaacaggcaaggtgctgacctaccggaacatcaaacagctgctcggcgacaactacaagctgctgaatcggcagcggcagcagaagcacttgctgagccaccagagacatatcgcccagagaatcgccgctcctaacaacttcggcgatagcgagctgggcgagtacatcgatagactgctggccaaagagatcattgccattgctcagacctaccaggccggctccatcgtgctgcctaacctgggagacatgcgcgagcagatccagagcgagattaaggccaaggccgagcagaagtctgacctggtcgaggtgcagaagaagtacgccaagcagtaccccaacagcgtgcaccagtggtcttacggcagactgatcaccaacatccagtctcagagcaagaaagccgggatcgtgatcgaggaaggcaagcagcagatccgggccagtcctctggaaaaagccaaagagctggccatcaacgcctaccagagcagaaaggcctga

SEQ ID NO: 1121 - DNA, 463 bp, Anabaena cylindrica
ttgacaaaacactgaaccttgataatagaatagtaattaacaatagcgccgcagttcatgttgttgatcaacctctgaactgagataaatgtgggttagtttgactgttgtgagacagtcttgctttctgaccctggtagctgcccaccttgatgctgctgtttcttgtaaacaggaataaggtgcgcccccagtaatagaggtgcgggtttaccgcagtggtggctaccgaatcacctccgagcaaggaggaatccaccttaattatttatttttggcgaaccataagcgaggtcaatttccctggggttctgccaaaagtccaaatcccttgtctagtctgtttttcagatgttgagatgctttgaaaatgttccctttaaagggaaattaagagcaaatttaggacatccgccaaaattgcttttggaagtgtcactaaataagggtttggtcgggcgga

SEQ ID NO: 1122 - DNA, 37 bp, Anabaena cylindrica; identical to SEQ ID NO: 810

SEQ ID NO: 1123 - DNA, 515 bp, Anabaena cylindrica
  misc_feature (492)..(515): n is a, c, g, or t
ttgacaaaacactgaaccttgataatagaatagtaattaacaatagcgccgcagttcatgttgttgatcaacctctgaactgagataaatgtgggttagtttgactgttgtgagacagtcttgctttctgaccctggtagctgcccaccttgatgctgctgtttcttgtaaacaggaataaggtgcgcccccagtaatagaggtgcgggtttaccgcagtggtggctaccgaatcacctccgagcaaggaggaatccaccttaattatttatttttggcgaaccataagcgaggtcaatttccctggggttctgccaaaagtccaaatcccttgtctagtctgtttttcagatgttgagatgctttgaaaatgttccctttaaagggaaattaagagcaaatttaggacatccgccaaaattgcttttggaagtgtcactaaataagggtttggtcgggcggagaaatcccggagtggggcgggttgaaagnnnnnnnnnnnnnnnnnnnnnnnn

SEQ ID NO: 1124 - DNA, 500 bp, Anabaena cylindrica
tctaacgataacgaataatgataaataccgtagtgcaatattatgctacaggaaacttaatcagtgtttacataatttgtgtacattaactaattatttgacaatttaacaaaatattgtcaaaaatcataaaaataccttaaaaccttctacagcaaagattgtaggaggtttttatttatctaatttgtgaacatcctccagacatatatttaacaaattaagtgtcaaaagccagataattatcaatttatttgtcaatttgccaaatacaggtaaattactatatttctgaaaatttcacacattaaatgtcacttttactctatactatacaaatatgttgtaattaaacattaatgtatatgaggaatgaaacacctctaactccgggcaatttgggagatgaaagtagcatcggcaaagaaactcaagttcttgtgtcggaactttctggcgaggcaaaactaaaaatggaggttattcaaagtctgttagaa

SEQ ID NO: 1125 - DNA, 500 bp, Anabaena cylindrica
gtttcaacacccctcccggagtggggcgggttgaaagacattaatgcaagtagaataaaaaatatctaggtgggttgaaagatcagtaggtcgtgggtttaactctgaaaacacttgaaaacactatataaatacagtgttgcttgtgacatttagggacaattaatttgttaacagtgacacgaattagttaaaaatgacattaatttgttaacagtgacaaataaattgttaatgtacagacatatagtgtgcgaatgtacaccaaagccgatgatgggatttgaacccacgacctactgattacgaatcagttgctctacccctgagccacatcggcatacacagtttgatatcatagcattatttacctatgatagacccaaattcccaaaatcgtcttaactctaaacaatatgcccacctgaaagctgaaatagcagccccttatcgtggtttgcggcaatttatctatataggtgttggtgcttctggtttta

SEQ ID NO: 1126 - DNA, 1749 bp, Anabaena species
atgaaccgggacgagaacagcgacctgaacaccagcgccattccagtggaatccatcagcgagggcgacaacacccctcctgagacaaatgtgatcgccaccgagctgagcgaggaaagccagctgaaactggaagtgctgcagagcctgctggaaccctgcgacagaacaacctacggccagaagctgaaagaggccgccgagaaactggctgtgtctgtgcgaacagtgcagcggctggtcaagaagtgggagcaagacggactcgtgggcctgacacagaccggcagaacagataagggcaagcaccggatcggcgagttctgggaagatttcatcgtgaaaacccacaaagagggcaacaagggcagcaagcggatgagccctaaacaggtggccatcagagtgcaggccaaggctcacgagctgtccgatctgaagcctcctaactaccggaccgtgctgagagtgctggcccctatcctggaaaagcaagaaaagaccaagagcatcagaagccccggctggcggggaacaacactgagcgtgaaaacaagagaaggcaaggacctgagcgtggactacagcaaccacgtgtggcagtgcgatcacacccctgctgatgtgctgctggtggatcagcatggcgagctgctgtctagaccttggctgaccaccgtgatcgacacctacagcagatgcatcatgggcatcaacctgggcttcgacgcccctagctctgaagtggttgctctggccctgagacacgccatcctgcctaagagatacagcctcgagtacaagctgcactgcgagtggggcacatacggcaagcctgagcacttctacaccgacggcggcaaggacttcagaagcaaccacctgtctcagatcggcgctcagctgggctttgtgtgccacctgagagacagacctagcgaaggcggcatcgtggaaagacccttcaagaccctgaacgatcagctgttcagcaccctgcctggctacaccggcagcaatgtgcaagaaagacccgaggatgccgagaaggacgccaagctgacactgagagagctggaacagctcattgtgcggtacatcgtggaccggtacaaccagagcatcgacgccagaatgggcgaccagaccagattcggaagatgggaagccggcctgccttctgtgcctgtgcctatcgaggaacgcgacctggacatctgcctgatgaagcagtctcggcggagagtgcagaaaggcggccatctgcagttccagaacctgatgtaccggggcgagtacctcggcggctatgatggcgaaaccgtgaacctgcggttcaaccccagagacatcaccaccgtgctggtgtaccggcaagagaacagccaagaggtgttcctgaccagggctcatgcccagggactcgagacagaacagctgtccctggatgaagccgaggccgcatctcggagactgagaaatctgggcaagaccatcagcaatcaggccctgctgcaagaggtgctggacagagatgcactggtggccaacaagaagtcccggaaggacagacagaagctcgagcaagagatcctgagaagcaccgccgtgaacgacagcaagaacgagtctctggctagccccgtgatggaagctgaggacgtggaattcaccacacctgtgcagagcagcagccccgagctggaagtgtgggattacgagcagctgcgggaagagtacggcttctga

SEQ ID NO: 1127 - DNA, 837 bp, Anabaena species
atgaccgatgacgcccaggccattgccaaacagctcggcggagtgaagcccgacgaagaatggctgcaggccgagatcacacacctgaccagcaagagcatcgtgcccctgcagcaagtgatcaccctgcacgattggctggacggcaagagaaaggccagacagagctgtagagtcgtgggcgagagcagaaccggaaagaccgtggcctgtgacgcctaccggtacagacacaagcccagacaagagatgggcaagacccctatcgtgcccgtggtgtacatccagcctccatctaagtgcggcgccaaggacctgttccaagagatcatcgagtacctgaagttcaaggccaccagaggcaccatcagcgacttcagaggccggaccatggaagtgctgaagggctgcagagtggaaatgatcatcatcgacgaggccgaccggatcaagcccgatacctttgctgacgtgcgggacatctacgacaagctgggaatcgccatcgtgctcgtgggcaccgatagactggaagccgtgatcaagcgggacgaacaggtgtacaaccggttcagagcctgccacagattcggcaagctggccggcaaggacttccaggatacagtgcaggcctgggaagataagatcctgaagctgcccctgcctagcaacctgatctccaaggacatgctgcggatcctgacaagcgccaccgagggctatatcggcggactggatgagatcctgagagaggccgccatcagaagcctgtccagaggcctgaagaaaatcgacaaggccgtgctgcaagaggtggtgcaagagttcaagctgtga

SEQ ID NO: 1128 - DNA, 480 bp, Anabaena species
atgatccagccttacgagggcgagagcctgagccacttcctgggcagattcagaagggccaaccacctgtctgctgccggcctgggaaatctggctggaatcggagccgtgatcgccagatgggagagattccacttcaaccccagacctagccagaaagagctggaagccattgccagcgtggtggaagtggatgcccagagactggccgaaatgttgcctcctgctggcgtgtccatgcagcacgagcctattagactgtgcggcgcctgttacgccgagacaccttgtcaccagatcaagtggcagttcaaagagacaggcggctgcgaccggcactacctgagactgctgagcaagtgccctaactgcgacgccagattcaagatccccgctctgtgggagctgggcgtgtgtcagagatgcctgatgacctttgccgagatggccggctaccagaagtccatcaacggcacctaa

SEQ ID NO: 1129 - DNA, 1920 bp, Anabaena species
atgagccagatcaccgtgcagtgcagactgatcgccagcgagagcacaagacagcagctgtggacactgatggccgagctgaacacccctctgatcaacgagctgctccagcagctgagcaagcaccccgattttgagaagtggcggaaggacggcaagttccccagcacagtggtgtctcagctgtgccagcctctgaaaaccgatcctcagtttgccggccagcctagcagatgttacctgagcgccatccacgtggtggactacatctacaagagctggctgaccatccagaagcggctgcagcaacagctggatggcaagatccggtggctggaaatgctgaactccgacgccgagctggtggaaacaagcggctattccctggaagccatcaggacaaaggccgccgagatcctggccatgacaacccctgagagcgacaccaatgtgcccctgaccaagaagcggaacaccaagaagtctaagaagtccagcgccagcaatcccgagcctagcctgagccacaagctgttcaacgcctaccaagagacagacgacatcctgagcagaagcgccatcagctacctgctgaagaacggctgcaagctgaacgacaaagaagaggataccgagaagttcgccaagcggcggagaaaggtggaaatccagatccagcggctgaccgacaagctgaccagcagaatccccaagggcagagatctgaccaacagcaagtggctcgagacactgttcaccgccatcaccaccgtgcctgaggataatgccgaggccaagagatggcaggacatcctgtctaccagaagcagcagcctgccttttccactgatcttcgagacaaacgaggacctgaagtggtccaccaacgagaagggcagactgtgcgtgcacttcaacggcctgaccgacctgaccttcgaggtgtactgcgacagcagacagctgcactggttcaagcggtttctggaagatcagcagaccaagcggaagtccaagaaccagcacagcagcggcctgttcaccctgagaaatggcagactggcctggcaagaaggcgaaggcaaaggcgagacatggcagatccacagactgaccctgagctgctgcgtggacaacagactgtggactgccgagggcacagagcaagtgcggcaagagaaggccgaggacatcaccaagtttatcaccaagatgaaggaaaagagcgacctcagcgacacccagcaggccttcatccagagaaagcagagcaccctgaccaggatcaacaacagcttcgacagaccctgcaagcccctgtaccagggccagtctcatatcctcgtgggcgtgtccatgggcctcgagaaacctgctacagtggccgtggtggatgccagcgctaacaaggtgctgacctaccggtccatcaagcagatcctgggcgagaactacgaactgctgaaccggcagcggagacagcagagaagcagctctcacgagagacacaaggcccagaagtctttcagccccaaccagttcggcacaagcgagctgggccagtacatcgatagactgctggccaaagaaatcgtggctatcgcccagacctacaaggccggctctatcgtgctgcctaagctgggcgacatgagagagaacatccagagcgagatccaggctattgccgagatcaagtgccccggcagcgtggaaattcagcagaagtatgccaagcagtaccggatcaacgtgcacaagtggtcctacggcaggctgatccagagcatccagtccaaggctgcccaagtgggcatcgtgatcgaagagggaaaacagcccgtgcgggacagccctcaggataaggctaaagaactggctctgagcacctaccacctgaggctggctaagcagagctga

SEQ ID NO: 1130 - DNA, 447 bp, Anabaena species
caaatatccgaaccttgacaataaaatagatttaatagcgccgccgttcatgctgcttgcagcctctgaacagtgttaaatgggggttagtttgactgtagcaatacagtcttgctttctgaccctggtagctgctcaccctgatgctgctgtcttaggacaggataggtgcgctcccagcaataagggtgcggatgtaccgctatagtggctaccgaatcacctccgatcaagggggaaccctcctcaattcttcatttgaagaactaaaatcaaggcaaaatttctcagagatccgcgcaagtcccaaaatgcttgtcctgtcgaaatctcatcgttttttcatcctgatatgatttttatgactgaggctcaaatagcaaattgggagacatccgcgctaacgacacctggaaaccttgccccacaatactttgaaactagatg

SEQ ID NO: 1131 - DNA, 38 bp, Anabaena species
ggtaacaacaaccctcctagtacagggtgggttgaaag

SEQ ID NO: 1132 - DNA, 499 bp, Anabaena species
  misc_feature (476)..(499): n is a, c, g, or t
caaatatccgaaccttgacaataaaatagatttaatagcgccgccgttcatgctgcttgcagcctctgaacagtgttaaatgggggttagtttgactgtagcaatacagtcttgctttctgaccctggtagctgctcaccctgatgctgctgtcttaggacaggataggtgcgctcccagcaataagggtgcggatgtaccgctatagtggctaccgaatcacctccgatcaagggggaaccctcctcaattcttcatttgaagaactaaaatcaaggcaaaatttctcagagatccgcgcaagtcccaaaatgcttgtcctgtcgaaatctcatcgttttttcatcctgatatgatttttatgactgaggctcaaatagcaaattgggagacatccgcgctaacgacacctggaaaccttgccccacaatactttgaaactagatggaaatcctagtacagggtgggttgaaagnnnnnnnnnnnnnnnnnnnnnnnn

SEQ ID NO: 1133 - DNA, 500 bp, Anabaena species
tttaagtatagtagtattatcaagggtaaaaatgtcaacatttcataatatcttccatccaatgaacataactgatttgttgacacatacaagattgaagatagcggaatttatctaacatcttttcaccccattctttcggaacagataaatgtacagtgactaattatatgtcatcgtgacaaattaatgtcatcttataaatccttgctgtagaaggattttagcaatttaacgatattatacttcaatccagttagtgacaaaataaatgtcgtttcccatgattgtgacaaattaactgtcgcgttaccgattaaaaaaagtttttgtatattttcataatgacaaattgactgtcgctttccagtaagctagaataacatcatgtttttataaaatctgtttgatttatgaacagagatgaaaattctgatttaaatacctcagctatccctgtggaaagcatatcagaaggagacaacacacctcctgagaca

SEQ ID NO: 1134 - DNA, 500 bp, Anabaena species
ggtaacaacaacccaccctatggtgggttgaaaggttatcatattcttataaaaagagggttgaaagagagtacatcgttgacatatcgctctgatatatcaataaatgacattaatttgtcactaccattaaaacgacaacaatttgtcctaacgacactaaattgtcaccgacgacatataattagtcactgtacaaaaagtatggacggtattggactcgaaccaacgaccccatcgatgtcaacgatgtactctaaccacctgagctaaccgtccttaatcccatagactaataacgtatcacataaaatataatttgtcaatccctaaaatccaaattttattctacatatatctagtcaactgtacccgatagcgatccttttttgtcaccgcaatttccccaacttccaaccgaccttttccccgaatagcgattaaatcccctgttttcacttgagaactggcttgagtgacttccttccaattgacacgca

SEQ ID NO: 1135 - DNA, 1665 bp, Cyanobacterium aponinum
atgaccatcgacaaccagttcagcgacagccccgagctgattagccagctgtctcccgaggaccagaaaatcgccgacgtgatcgagaacctgctgcagccctgcgacaagaaaacctacggcaagaagctgaagcaggccagcgaccagctgaagaaaagcgtgcggaccatccagagatacgtgaagcagtgggaagagaacggcctcgtgggcatcctgcagaacaacagagccgacaagggcagctaccggatcgaccctagactgcaggacttcatcctcaagacctacagagagggcaacaagggctccaagcggatgacccctaaacaggtgtacctgagagccgtggtgcaggccgagaattggggaatcaagcctcctagccacatgaccatctaccggattctgaaccccatcattgccgagaaagagaacaagaagcggatcagaagcagcggctggcggggatctcaactggtgctgtctacaagatccggcaccgagatcgacgtgcagtacagcaatcacgtgtggcagtgcgaccacaccagagccgatatcctgctggtggatcagttcggcgaactcctgggcagaccctggatcaccattgtggtggacacctacagccggtgcatcatgggcatcaacctgggctttgatgcccctagcagccaggttgtgacactggccctgagacacgccatcctgcctaagagctacagcagcgactacgagctgcacgaggaatggggcacatacggcaagcccgagtacttctacaccgacggcggcaaggacttcagaagcaaccatctgcagcagatcagcctgcagctgggcttcacctgtcacctgagaagcagacctagcgaaggcggcgtggtggaaagactgttcaagaccctgaacacagaggtgttcagcaccctgcctggctacacaggcgccaatgtgcaagaaagacccgaggacgccgaaaaagaggcctgtctgaccctgaaagagctggaaatcctgatcgtgcggtacatcgtggacaactacaaccagcggatcgacgccagaatgggcgagcagaccagattccagagatgggagagcggcctgctgagcacccctcacattatccctgagcgcgagctggacatctgcctgatgaagcagtccagacggaaggtgcagaaaggcgggcatctgcagttcgagaatctgatctacaagggccagtacctggccggctatgagggcgagacagtgatcctgagatacgaccccagagacatcaccggcatcctgatctatcgcgtcgagaacaacaaagagatcttcctgaccagagcctacgccaccgacctggaaggcgattgtctgagcctgaccgatgccaagagcagcgtgaagagaatccgcgagaagtccaagaacgtgcacaacaagtccatcctgatggaaatccagcagcggcacctgttcagcgagaagaaaacaaagaagcagattcagcaagaggaacagaaacagatcaagcccaacaccagcctgagcatcttcaagcccgaaaccgagatggacacccaggtggaaagcagccaagagctgagcgaagaggacctggacatcgagatgatcgactacggcaacctgcagcagtactga

SEQ ID NO: 1136 - DNA, 834 bp, Cyanobacterium aponinum
atggaagccaaagagatcgcccagcagctgggagaagtggaacagcccaatcagagcctgcagaacgagctggaccggctgagcaagaagcagttcctgttcctggaccaagtgaagatctaccaccagtggctgaacgagcggctgttcatgaagcactgctgcagagtcgtgggcgatagccacacaggcaagacatctagcagccaggcctactgcctgcggtacaagagcacacaagagagcggcaagaaccctatcttccccgtgctgtacgtgtccgtgcctgagaatgccaccagcaaggtgttcttcgaaaccagcatcaagagcttcggctaccggatcagcaagggcaccatcagcgacctgcgggaaagaatgctgaccctgctgagccggtgccaagtgaaaatgatgatcattgacgaggccgaccggtgcaagcccgagacactgagctacatccgggacatcttcgaccacctgaacatctgcatcgtgctcgtgggcaccgacagactgaacaccgtgctgaagagggacgaacaggtgtacaaccggttcctgccttgctacagatacggcctgctggacaaagagagcctgatcaagaccatcaagatctgggagatcaagatcctgaagctgcccgtggccagcaatctgagccagggcaagaagttcaacatcatctacagcacctccaagggctgcctgggcaccatggataagctgctgagaaccagcgccagcatggccctgatcagaggactgtccaagatcgagctgaacatcctggaagaggccgctcacctgttcaaggacaagtga

SEQ ID NO: 1137 - DNA, 492 bp, Cyanobacterium aponinum
atgatcaccaacagcttcgacagctggatcctgatgctggacccttaccagggcgagagcatcagccactttctgggcagattccggcgcgagaatagcctgaccgtgaacaacctgggcaaagccacagagctgtacggcgccattgccagatgggagaagttccggttcaaccctccacctagcagcgagcagctgaagaaactgagcgccatcgtgcaggtcgaggtggccacactgcagaccatgtttcccagcgctcccatgaagatgacccctatcagactgtgcagcgcctgctacggcgagaagccctaccacaagatggaatggcagtacaaagaaatctacaagtgcgaccggcaccagctgaagctgctgagcgagtgtcctaattgcggcgccagattcaagttccccagcctgtgggttgacggctggtgccacagatgcttcacccctttcgccgagatgaagcagcagaaggactga

SEQ ID NO: 1138 - DNA, 1872 bp, Cyanobacterium aponinum
atggtgcaagtgaccatccagagcagactgatcgccagcgccgataccagacagtctctgtggctgctgatgagcaagaagaacacccctctgatcaacgagatcctgacgcggatcaagcaccatcctgacttccctcagtggcgcgagaaaggcagactgcccaagaactttatcgcccagcagatccaagagctgaagaacgacagccggttccagggccagcctagcagattctatgccagcgtgggcaagatcatcgactacatctacaagagctggttcaaggtgcagaagtcctacaagattcagctggaaggcaacagccggtggctggaaatgctgaagcctgacagcctgctgatcgagagcttcgacggctctatggaagccctgcagaatcaggcccagcaaatcctggacaacatcgagacaaccagcacacaagagggcatcgtggactacctgttccagaagtacgagaagatcgagaactgccggatgaaggacgccatcgtgtacctgatcaagaacggcagcagaatccccaagaacaatatcgaaaccaccaagaagtacaagcgcatcaagcggaagctcgagatcaagatccggaagctgaagcgccaggtggaaatgagcatccccagcggcagagatctggaaggcgagaagtggctgcacaccctgatcctggccagcaacaccatgcctgtggatcagagcgagagcgacagctggtttagcgccctgaagagaaacagccctagcatcccctatcctatcgtgtacgagagcaacgaggacctgacctggtgcctgaacaaccagaaccggatctgcatcaagttcagcggcctgagcgaccacctgtttcagatctactgcgacagcaggcagctggcctacttcagacggttctacgaggaccaagaactgaaaaaggccagcaaggaccagttcagcagcgccctgtttaccctgagaagcgccatgatcatctggaaagaggacgacggcaagggcgagagctgggacaagcacaagctgtacctgcactgcaccttcgacaccgactactggaccgtggaaggcacccaagtgatcgcccagaaaaagcaagaggaagtcctgaacctgatcgaccgcatgaaggaaaagaccgacctgaccgacacacagaaggcctttatccagcggaagcagaccacactggcccggctgaacaacatcttccccagacctagcaagcccatctaccagggcaaccccaatctgtttctcggcgtggccatgggcctgcaagagcctgttacaatcgccctggtggatgtgtccaccaacaaagtgatcctgtaccggaacatcaaacagctgctgggagacaactaccatctgctgcggagaaggcggaacgagaagcagaagctgaatcaccagaaccacaaggcccggaagcgggccaattttcagcagaagggcgagtccaacctgggcgagtacctggacagactgattgctaagagcatcctgcagatcgccaaagaataccaggtgtccacaatcatcgtgcccagactgaaccagatgcggagcatcaccgaggccgagattcaggccagagccgaggaaagaatccccgagtacaaagaaggccagaggaagtacgcccaggactacagagtgcaggtccaccagtggtcctacggcaggctgatcgacaacatcaaggccatcagctccaagctgggaatcgtggtggaagagggcaagcagcctaagcagggcaccttcacagataaggcctctcagctggctctgagcacccagaagaacaaccggcagaacaaccccaaaaagaccaacagctga

SEQ ID NO: 1139 - DNA, 432 bp, Cyanobacterium aponinum
gttacaatgagggaaatcgtgccgccgatcaagttgttgtcaacctctgttctgcgaaaaatgaggggtagtttacctagtaataggtttgctttctgtccctgataactgctcactctgatgctgcgcactgaataaagtgcggaaacaaggggcactcccagcaaaaggagtttgggtgtaccaatgtagtggttatccaatcacctccgatcaaggaggaatcccaatttaagcgttagttaaaatgtacgagttacactaattcggattttatccttacgcaatcgctgaaactcctataaattaagagatatagcgttttaagaaaatgcagaattccagtcaaaatcagaattttcgtatttttagaggtggcttacgcaaactgcttttacaagccttattttataaggactctgactaggggca

SEQ ID NO: 1140 - DNA, 37 bp, Cyanobacterium aponinum
gttgaaataagacaataccttctatagggattgaaag

SEQ ID NO: 1141 - DNA, 484 bp, Cyanobacterium aponinum
  misc_feature (461)..(484): n is a, c, g, or t
gttacaatgagggaaatcgtgccgccgatcaagttgttgtcaacctctgttctgcgaaaaatgaggggtagtttacctagtaataggtttgctttctgtccctgataactgctcactctgatgctgcgcactgaataaagtgcggaaacaaggggcactcccagcaaaaggagtttgggtgtaccaatgtagtggttatccaatcacctccgatcaaggaggaatcccaatttaagcgttagttaaaatgtacgagttacactaattcggattttatccttacgcaatcgctgaaactcctataaattaagagatatagcgttttaagaaaatgcagaattccagtcaaaatcagaattttcgtatttttagaggtggcttacgcaaactgcttttacaagccttattttataaggactctgactaggggcagaaaaataccttctatagggattgaaagnnnnnnnnnnnnnnnnnnnnnnnn

SEQ ID NO: 1142 - DNA, 500 bp, Cyanobacterium aponinum
atacaagaatcaaaaaatttgaaaattacaaaggcttacggagtttgacaaaagaaagagtattgattcaagtttaagtaagatagtaagctcttgtacagtaacaaattaaatgacgtgataacaaattagtgttatctaaaaataagactcttcaaatctttgcatatcaataattataactaattcttcccctaaaacaaggagcgatcgcacctcaaatgggattaacaaattaagtgtcatcttccagaaaaataacaaattaaatgtcgtctttctaaaaggcgattttttgttttaggggttgtcattaacaaattagatgtcctaagattagtataaaaccattatgattttattaaacagctaagagaaaactatgaccatcgataatcaattttctgattctccagaattgatctctcaactttctcccgaagaccaaaaaatcgctgatgttattgaaaatttacttcaaccttgtgacaagaaaactt

SEQ ID NO: 1143 - DNA, 500 bp, Cyanobacterium aponinum
gttgaaataagacaataccttctatagggtttataatattaatagtgccgtagatcaagttttcataacctctgttctatgaaaaatgaggagtagtttacttcttataagaagtttgctttctgcttctgctaactacttgccctgatgctgtctatcttaaagatagagaaactaggcgcactcccagcaataagggtgcaggtgtactgctatagcggttagcgaatcacttccgagcaaggaagaattctctttgagaattgaaagcgagtccctccacgtcctagtcattgaattggcgacattaatttgtgatcacgtcatttaatttgttaagacgacattaatctgttaccgatgacaaataatttgttactgtacagctctaatcttttagagttaactgttatgactttggagctatctataatttatttacgggcgtggagggactcgaacccccgacctgctgatccgtagtcagccgctctaatcca

SEQ ID NO: 1144 - DNA, 1731 bp, Cuspidothrix issatschenkoi
atgtacatgcggaacgagacacccatcacacccgacaacctggaaaccgagagcgtgaccgccaaggacacccagatcatcgtgtctgagctgagcgacgaggccaagctgaagatggaaatcatccagagcctgctggaagccggcgacagaacaacatacgcccagagactgaaagaggccgccgtcaagctgggaaagtctgtgcggacagtgcggcggctgatcgacaagtgggaacaagagggactcgtgggcctgacacagaccgacagagtggataagggcaagcaccgcgtggacgagaactggcaagagttcatcctgaaaacctacaaagagggcaacaaaggcggcaagcggatgaccagacagcaggtcgccatcagagtgaaagtgcgggcagatcagctgggcgtgaagcctccatctcacatgaccgtgtaccggatcctggaacctgtgatcgagaagcaagagaaggccaagagcatcagaacccctggctggcggggaagcagactgagcctgaaaacaagagatggcctggacctgagcgtggaatactccaaccacatctggcagtgcgaccacaccagagccgatatcctgctggtggatcagcacggcgaactgctggctagaccttggctgaccaccgtgatcgacacctacagcagatgcatcatcggcatcaacctgggcttcgacgcccctagttctcaggttgtggctctggccctgagacacgccatcctgcctaagaagtatggcgccgagtacggcctgcacgaggaatggggaacatacggcaagcccgagcacttctttaccgacggcggcaaggacttcagaagcaaccatctgcagcagatcggcgtgcagctgggctttgcctgtcacctgagagactgtcctagcgaaggcggcatcgtggaaagacctttcggcaccctgaacaccgacctgttctctaccctgcctggctacaccggcagcaacgtgcaagaaagacctgaggaagccgagaaagaagcctgtctgaccctgagagagctggaacggctgctcgtcagatacctggtggacaagtacaaccagagcatcgacgccagactgggcgatcagaccagataccagagatgggaggccggactgatcgtggcccctaacctgatcagcgaagaggacctgcggatctgcctgatgaagcagaccaggcggagcatctacagaggcggctacctgcagttcgagaacctgacataccggggcgagaatctggccggatatgccggcgaatctgtggtgctgagattcgaccccaaggatatcaccaccatcctggtgtaccggcagaccggctttcaagaagagttcctggccagagcttacgcccaggatctggaaacagaggaactgtccctggatgaggccaaggccatgagcagaagaatccggcaggccggcaaagagatcagcaacagatccatcctggccgaagtgcgcgaccgggaaaccttcgtgaagcagaaaaagaccaagaaagagcgccagaaagaggaacaagtcgtcgtcgagaaggcctccagcgagagaagcagaaccgccaagaaacccgtgatcgtggaacccgaagagatcgaggtggccagcgtggaaagcagcagcgacacagatatgcccgaggtgttcgactacgagcagatgagagaagattacggctggtga

SEQ ID NO: 1145 - DNA, 837 bp, Cuspidothrix issatschenkoi
atgatcagccagcaggctcagggcgttgcccaagagctgggagacatcctgcctaacgacgagaagctgcaggccgagatccaccggctgaacagaaagagcttcatccctctggaacaagtgaagatgctgcacgactggctggacggcaagagacagagcagacagtctggcagagtgctgggcgagagcagaaccggcaagaccatgggctgtgacgcctacagactgcggcacaagcctaagcaagagcccggcaaacctcctacagtgcccgtggcctacatccagattcctcaagagtgcagcgccaaagagctgttcgccgccatcatcgagcacctgaagtaccagatgaccaagggcaccgtggccgagattagagacagaaccctgcgggtgctgaaaggctgcggagtggaaatgctgatcatcgacgaggccgaccggttcaagcccaagacctttgctgaagtgcgggacatcttcgacaagctggaaatcgccgtgatcctcgtgggcaccgatagactggatgccgtgatcaagcgggacgaacaggtgtacaaccggttcagggcctgccacagattcggcaagtttagcggcgaggacttcaagcggaccgtggaaatctgggagagacaggtgctgaagctgcctgtggccagcaatctgtctggcaaggccatgctgaaaaccctgggagaagccaccggcggctatatcggactgctggacatgatcctgagagagagcgccattcgggccctgaagaagggcctgtctaagatcgacctggaaaccctgaaagaagtgaccgccgagtacaagtga

SEQ ID NO: 1146 - DNA, 522 bp, Cuspidothrix issatschenkoi
atggaagtgggcgagatcaacccatggctgttccaggtggaacccttcgagggcgagagcatctctcactttctgggcagattcagacgggccaacgacctgacaacaaccggcctgggaaaagccgctggtgttggcggagccatcagcagatgggagaagttccggttcaaccctccacctagccggcagcaactggaagccctggccaaagtcgtgggagtcgatgccgatagactggccagaatgcttcctcctgctggcgtgggcatgaacctggaacctatcagactgtgcgccgcctgctacgtggaaagcccttgtcacagaatcgagtggcagttcaaagtgacccagggctgcgaggatcaccacctgtctctgctgagcgagtgccctaattgcggcgccagattcaaggtgccagctctgtgggttgacggctggtgcctgagatgcttcaccctgtttggcgagatggtcaagagccagaacttcatcgagagccacaacaagatctga

SEQ ID NO: 1147 - DNA, 1899 bp, Cuspidothrix issatschenkoi
atgagccagatcaccatccagtgcagactgctggcctccgagagcacaagacagcagctgtggcagctgatggccgagaagaacacccctctgatcaacgagctgctgatgcagatgggcaagcaccccgagtttgagacatggcggcagaagggaaaacaccccaccggcgttgtgaaagagctgtgcgagcccctgaaaacagaccccagattcatgggccagcctgccagattctacaccagcgctaccgccagcgtgaactacatctacaagagttggttcgccctgatgaagcggttccagagccagctggatggcaagctgagatggctggaaatgctgaacagcgacaccgagctggaagccgcaagcggagtgtctctggatgtgctgcagacaaagagcgccgagattctggcccagttcgccgctcagaatcctgccgaaacacagcccgccaagggcaagaagggcaaaaagtcccctaccagcgacagcgagagaaacctgagcaagaacctgttcgacgcctactccaacaccgaggacaacctgaccagatgcgccatctcctacctgctgaagaacggctgcaagatcagcaacaaggccgagaacaccgacaagttcgcccagcggagaagaaaggtggaaatccagatccagcggctgaccgagaagctggccgccagaattcctaagggcagagatctgaccgacacactgcggctggaaaccctgttcaacgccacacagaccgtgcctgagaacgagacagaggccaaactgtggcagaacatcctgctgcggaagtccagccaggtgccatttcctgtggcctacgagacaaacgaggacctcgtgtggttcaagaatcagttcggccggatctgcgtgaagttcagcggactgagcgagcacaccttccagatctactgcgacagcagacagctgcactggttccagcggtttctcgaggaccagcagatcaagaaggactccaagaaccagcacagcagcgccctgttcacactgagaagcggcagaatcagctggcaagaaggccaaggcaaaggcgagccctggaacatccaccacctgacactgtactgcagcgtggacaccagactgtggaccgaagagggcaccaacctggtcaaagaggaaaaggccgaggaaatcgccaagacaatcacccagaccaagaccaagggcgacctgaacgataagcagcaggcccacctgaagagaaagagcagctctctggcccggatcaacaatcacttccccagacctagccagcctctgtacaagggcctgagccatatcctcgtgggagtgtccctgggactcgagaaccctgccacaattgctgtggtggacggcaccacaggcaaggtgctgacctaccggaacatcaaacagctgctcggcgagagctacaagctgctgaatcggcagcggcagcagaagcacctcctgtctcacgaaagacacgtggcccagagaatgagcgcccctaaccagtttggcgatagcgagctgggcgagtacatcgataggctgctggccaaagaaatcattgccgtggctcagacctacaaggccggcagcatcgtgatccccaagctgggagatatgagagagcagatccagtccgagatccagagcaaggccgaacagaagtccgacatcatcgaggtgcagcagaaatacgccaagcagtaccggaccaccgtgcaccagtggtcttacggcagactgatcagcaatatccagtctcaggcctctaaggccggaatcgccatcgaggaaggcaagcagccaatcagagcctctccactggaaaaagccaaagagctggccatctccgcctaccagagcagaaaagcctga

SEQ ID NO: 1148 - DNA, 468 bp, Cuspidothrix issatschenkoi
ttgacaaaataccgaaccttaataatagaataggaattaacaatagcgccgcagttcatgtttttgataaacctctgttcggtgacaaatgcgggttaggttgactgttgtgagacagttgtgctttctgaccctggtagctgcctaccttgatgctgctgttccttgtgaacaggaataaggtgcgcccccagtaatagaggtgcgggtttaccgcagtggtggctaccgaatcacctccgagcaaggaggaatccaccttaattatttatttttggcgaaccataagcgaggtcaaaaaccctggggttctgccaaaggtctaaatccgttgtctagtctgtgtttcagatgttaagatgctttgataatgttctcttcagagggaaattaggagcaaatttaggacatctgccaaaattgcttttggaggtgtctttagataagggtttggtcgggcggagtttt

SEQ ID NO: 1149 - DNA, 37 bp, Cuspidothrix issatschenkoi
gttttaacacccctcccggagtggggcgggttgaaag

SEQ ID NO: 1150 - DNA, 520 bp, Cuspidothrix issatschenkoi
  misc_feature (497)..(520): n is a, c, g, or t
ttgacaaaataccgaaccttaataatagaataggaattaacaatagcgccgcagttcatgtttttgataaacctctgttcggtgacaaatgcgggttaggttgactgttgtgagacagttgtgctttctgaccctggtagctgcctaccttgatgctgctgttccttgtgaacaggaataaggtgcgcccccagtaatagaggtgcgggtttaccgcagtggtggctaccgaatcacctccgagcaaggaggaatccaccttaattatttatttttggcgaaccataagcgaggtcaaaaaccctggggttctgccaaaggtctaaatccgttgtctagtctgtgtttcagatgttaagatgctttgataatgttctcttcagagggaaattaggagcaaatttaggacatctgccaaaattgcttttggaggtgtctttagataagggtttggtcgggcggagttttgaaatcccggagtggggcgggttgaaagnnnnnnnnnnnnnnnnnnnnnnnn

SEQ ID NO: 1151 - DNA, 500 bp, Cuspidothrix issatschenkoi
aaggggaaagagggaacagggaatagggaacagggaatagggaacagggaacagggaatagggaatagggaatagggtaaagaggcaatatttttgtacattaactaattatttgtcaatttaacaaaatattgtcacaaaaaataaaaattattgaaaccctgctataacaaggatcatagcagggtttagttattataccttctaatcattttgtgaaaccttttttaacaaattaattgtcaaaaaagggaaaattaacaatttaagtgtcaattcccaaaatccatgtaaactactctacttctgaaaatttcacacattaaatgtcacttttgatttataatatacaaatatgttccaattaaacatcaatgtatatgaggaatgaaacacctataactccagacaacttagaaactgaaagtgttaccgccaaagatactcaaatcattgtgtcggaactttccgacgaggcgaaactaaaaatggagattatt

SEQ ID NO: 1152 - DNA, 500 bp, Cuspidothrix issatschenkoi
aacacccctcccggattggggcgggttgaaagacatttatgcaagtataataaaaaatatctgggtgggttgaaagatcagtaggtcgtgggtttaactctgaaaacactatataaatacagtgttgcttgtgatagttagggacaattaatttgttaacagtgacacgaattagttaaaatgacattaatctgttaacagtgacaaataaattgttaatgtacacgaacgtacaacctaaagccgatgatgagatttgaactcacgacctactgattacgaatcagttgctctacccctgagccacatcggcgcatacagtctagtataataacataatttactaatgatggaacaaaattctcaaaataatcttaaacctcaacaatatcaacgcctcaaagccgaagcagccgcaccctatcggggtttgcggaaatttatctatatcagcgtcggtgcatcgggctttatcggtgcattcgtcttcttctttcaac

SEQ ID NO: 1153 - DNA, 1866 bp, Chlorogloea species
atggccgacgaggaattcgagctgaccgaggaactgacccaggtgccagacaacatcctgctggacaagcggaacttcgtggtggaccccagccagatcatcctggaaaccagcgacagacagaagctgaccttcaacctgatccagtggctggccgagtctcccaacagaaccatcaagagccagcggaagcaggccgtggccgatacactgaatgtgtccaccagacaggtggaacggctgctgaagcagtacgacgaggaccggctgattgagacagccggaatcgagagagccgacaagggcaagtaccgggtgtccaagtactggcaggacttcatcaagaccatctacgagaagtccctgaaggacaagcaccctatcagccccgcctctatcgtgcgcgagctgaagagacacgccatcgtggatctgggactgaagcctggcgacttccctcaccaagccaccgtgtacagaatcctggatcctctgatggaacagcacaagcgcaagaccaaagtgcggaatcctggcagcggcagctggatgacagtggtcacaagagagggccagctgctgaaagccgacttcagcaaccagatcattcagtgcgaccacaccaagctggacatccggatcgtggacatccacggcagcctgctgtctgacagaccttggctgaccaccattgtggacacctacagcagctgcgtcgtgggcttcagactgtggatcaagcagcctggcagcaccgaagttgccctggctctgagacatgccatcctgcctaagcactaccccgacgactaccagctgaacaaggcctgggagatctggggccctccattccagtactttttcaccgacggcggcaaggacttcagaagcaagcacctgaaggccatcggcaagaaactgggcttccagtgcgagctgagggacagacctcctgaaggcggcatcgtggaacggatctttaagaccatcaacacccaggtcctgaaggatctgcctggctacacaggcgccaacgtgcaagaaagacccgagaacgccgagaaagaggcctgcctgaaaatccaggatctggatcggatcctggccagcttcttctgcgacatctacaaccacgagccttatcctaagcagccctgcgacaccagatgcgagagatggttcaaaggcatgggcggcaagctgcctaggatcctggacgagagagagctggatatctgcctgatgaaggaagctcagagagtcgttcaggcccacggctccatccagttcgagaacctgatctacagaggcgagtctctgaaggcctaccggggcgagtatgtgaccctgagatacgaccccgaccacatcctgacactgtacgtgtacagctgcgagacagacgacggcgtggaaaacttcctggattacgcccacgccgtgaacatggacacccacgatctgagcgtggaagaactgaaggccctgaacaaagagcggagcaaggccagaagagagcacttcaactacgacgccctgctggccctgggcaagagaaaagaactggtggaagagtgcaaagaggacaagaaagagaagcggcggctggaacagaagcggctgagaagcaccagcaagaaaagcagcaacgtgatcgagctgcggaagatcagagcctccaccagcctgaagaaggacgacagacaagaggtgctgcccgagagagtgggccgcgaggaaatcaagatcgagagaatcgagccccagctgcaagaggacatcagcgtgcagaccgacactcaagaggaacagcggcacaagctggtggtgtccaaccggcagaagaacctgaagaaaatctggtga

SEQ ID NO: 1154 - DNA, 855 bp, Chlorogloea species
atggccagaagccagctgaccacacagagcttcgtggaagtgctggcccctcagctggacctgaaggatcagatcgccaagaccatcgacatcgaggaactgttccggacctgcttcatcaccaccgacagagccagcgagtgcttcaagtggctggacgagctgcggatcctgaagcagtgtggcagagtgatcggccccagagatgtgggcaaaagcagagctgccctgcactaccggaacgaggacaagaaacgggtgtcctacgtgaaggcttggagcgccagcagcagcaagagactgttcagccagattctgaaggacatcaaccacgccgctcctaccggcaagagacaggatctcagacctagactggccggcagcctggaactgtttggcctggaaatcgtgatcatcgacaacgccgagaacctgcagaaagaggccctgatcgatctgaagcagctgttcgaggaatgccacgtgccaatcgtgctcgtcggcggaaaagagctggacgatatcctgcagggctgcgacctgctgaccaactttcccacactgtacgagttcgagcggctggaatacgaggacttcagaaagaccctgagcaccatcgagttcgatgtgctggcactgcccgaggcctctaatctcggcgagggcaacatcttcgagatcctggccgtgtccaccaacgccagaatgggcctgctggtcaagatcctgacaaaggccgtgctgcacagcctgaagaacggcttcagcagagtggacgagagcatcctggaaaagatcgccagcagatacggccggaagtacatccctctggaaaaccggaaccggaacggctga

SEQ ID NO: 1155 - DNA, 537 bp, Chlorogloea species
atggacgaggacaacaagatcctgcctaagctggcctacgtggaaccctacatcggcgagagcatcagccactacctgggcagactgcggagattcaaggccaacagcctgcctagcggctacagcctgggaaagattgctggactgggcgccgtgatcagcagatgggagaagctgtacttcaacccgtttcctacacagcaagagctggaagccctggcctctgttgtgggagtgaacgccgatagactgaccgagatgctgcctcctaagggcatgaccatgaagcccagacctatcagactgtgcggcgcctgttatgccgagtctccctgccacagattcgagtggcagttcaaggacatcatgaagtgcgacggctacgccggcagaaggcacagacacgaactgagactgctgaccaagtgcatcaactgcgagacaccctttcctatacctgccgactggatcaagggcgagtgccctcactgtagcctgcctttcgccaacatggccaagcggcagagaagagactga

SEQ ID NO: 1156 - DNA, 1908 bp, Chlorogloea species
atgagcgtgatcaccatccagtgcagactggtggccgaagaggacttcctgagacagctgtgggagctgatggccgagaagaacacccctctgatcaacgagctgctggctcagctgggaaagcaccctgagctggaaacctggctggaaaagggcaagatccccacagagctgctgaaggccctgggcaacgccctgaaaacccaagagccttttgccggccagccaggcagattctacacaagcgccattgctctggtcaactacgtgtacaagagttggttcgccctgcagaagcggcggaagtaccagatcgagggcaaagaacggtggctgaagatgctgaagtccgacctggacctggaacaagagtcccagtgtagcctggacgtgatcagaatcaaggccaccgaactgctgaccaagttcacccctcagttcgacaccaacaacaagcagcgcaaggggaagaagaacaagaaggccagcaagacccagaaacctagcgtgttcaaggtgctgctgaacacctacgaagagacacagtgcctgctgacaagatgcgccctggcctacctgctgaagaacaactgccagatcagcgagctgaacgagaacctggaagagttcacccggaaccggcggaagaaagagatcgagatcgagcggctgaaggaccagctgcagagcagaatccccaagggcagagatctgaagggcgaagagtggctgaaaatcctcaagatcgccaccgccaacgtggcccaggatgagaatgaagccaaagcctggcaggccgctctgctgagaaagaccaagaacgtgccctttccagtggactacgagagcaacgaggacatgacctggctcaagaacgacaagaaccggctgttcgtgcggttcaacggactgggcaagctgaccttcgagatctactgcgacaagcggcatctgccctacttccagcggttcctggaagatcaagagatcaagcggaacagcaagaaccagtacagcagcagcctgttcacactgcggagcgccagaatctcttggctgcccgggaaagagaaaggcgaggcctggaaagtgaaccagctgaacctgtactgcagcctggacaccagaatgtggaccaccgagggcacaatccaggtggtggaagagaaagtgatggccattaccgagacactgaccaagaccaagcagaaggacgacctgaaccacaagcagcaggccttcatcaccagacagcagagcacactgaaccggatcacaaacccctttccacggccttgcaagcccacctatcagggcaagccttctatcctgctgggcgtgtccttcggcctggataagcctgctacagtggccgtggtggatgccgccaacaaaaaggtgctggcctacagaagcaccaaacagctgctgggcaagaactacaatctgctgaaccggcagcggcagcagcaacagagactgagccacgagagacatatcgcccagaagcagaacgcccctaacagctttggcgagtctgagctgggccagtacgtggacagactgctggctgacgccatcattgccattgccaagacctaccaagtgggcaacatcgtgctgcccaagctgcggtacatgagagagcagatcagcagcgagatccagagcagagccgagaaaaagtgccccggcttcaaagaggcccagcagaagtacgcccaagagtacagaatcagcgtgcaccggtggtcctatggcaggctggtggaatccatcaagagccaggccgccaaggccggcatctctacagagattgtgaccctgctgacccggggcagccctgaggaaaaagctagagatctggccgtgttcgcctaccaagagagacaggccgcactgatctga

SEQ ID NO: 1157 - DNA, 480 bp, Chlorogloea species
tttacttccgaaccttgaaaatataatatggatataacagcgccgcagttcatgctctttaaagcctctgtactgtgaataatctgggttagtttggtggttggaagaccgtcatgctttctgaccctggtagctgcccgcttctgatgctgctgtcgccagacaggataggtgcgctcccagcaataaggagtaaggcttttagccatagtcgttattcataacggcgtggatctccacagtggtggctactgaatcacccccttcgtcgggggaaccctcccaaatattttttggcaaaccgaagcgaggtgaaaaccctggagctttgccaaaatattgaatcccttgtccagtattggtttgattctttggaggagtgatgaatctcctcacattaaagcagaaaagcgagtattttgacagggttgccaaaattgcatctggaaccctgtactaacaaggggtcagacgggtgcg

SEQ ID NO: 1158 - DNA, 37 bp, Chlorogloea species
gtttcaaagaccatcccggctggaggtaagttgaaag

SEQ ID NO: 1159 - DNA, 532 bp, Chlorogloea species
  misc_feature (509)..(532): n is a, c, g, or t
tttacttccgaaccttgaaaatataatatggatataacagcgccgcagttcatgctctttaaagcctctgtactgtgaataatctgggttagtttggtggttggaagaccgtcatgctttctgaccctggtagctgcccgcttctgatgctgctgtcgccagacaggataggtgcgctcccagcaataaggagtaaggcttttagccatagtcgttattcataacggcgtggatctccacagtggtggctactgaatcacccccttcgtcgggggaaccctcccaaatattttttggcaaaccgaagcgaggtgaaaaccctggagctttgccaaaatattgaatcccttgtccagtattggtttgattctttggaggagtgatgaatctcctcacattaaagcagaaaagcgagtattttgacagggttgccaaaattgcatctggaaccctgtactaacaaggggtcagacgggtgcggaaatcccggctggaggtaagttgaaagnnnnnnnnnnnnnnnnnnnnnnnn

SEQ ID NO: 1160 - DNA, 500 bp, Chlorogloea species
tgcccggttgattaaaggaagaaccgacctatcaagcggacactaatttgtcaaagcgacatcaatttgacaacgacgacaaataattagtcaatcgacaaattttgtacattcgcacattatatgtcgcaattctcaagccaggtcgtaactgcttttaaagcctgagaactcaatcgtgtaaccatcgtagtctatttacctataaaagacaaactaacttgattcgcatattgtacgtcgtaaacgtcagtttcgcaaattgattgtcgtttatgaaaatttaggtgttttgcaaattagaagtcgcatttttgataagataatggtacattagtaccttaattatttacgagtggatttcactctaatggcagacgaagaatttgaacttactgaagaattgacacaagttccggacaatattttacttgacaagagaaattttgtcgtagacccatcgcaaattattctggaaacttcggataggcaaaaactga

SEQ ID NO: 1161 - DNA, 500 bp, Chlorogloea species
gtttcaaagaccatcccggctggaggtaagttgaaagaggcgtgagtggtgaggttcaaaaactatccgaccaggggtatgttagaagagaatagcaatttttgttattgatacttcacggatgtatttttcaaggggagggtagaaaggcgcacttcgttcgggattatcctaaagtttgtcagtaaattataaaagtagtggactaaacttcatcttaagacagtctacgacatcaatttgcaaaaactcagtgtgattaaatcacatcattaaaactactaaggcaacattaatttgcgagtaacgacactaatttgcgaattgcgacatataatgtgcgaatgtacaaatttaagtcgggatgactggattcgaaccagcgaccccttcgtcccgaacgaagtgcgctaccaagctgcgctacatcccgcgaaaaaatgctttcatttcacgcctttctatcctacaccaaacgcaccaattcccgcacttttaga

SEQ ID NO: 1162 - DNA, 1692 bp, Myxosarcina species
atgaacagcgagagcaccagcgagacaaacagcaagctggccatcagcgacctggaagatgaccgcgagatcgtgatcaccagccagctggaaggcaaggccaaagaacggctggaagtgatccagagcctgctggaaccttgcgacagagccacatacggcgagagacttagagctggcgccaagaaactggacatcagcgtcagaagcgtgcagcggctgttcaagaagtaccaagagcagggcctgacagccctggtgtccaccaacagagtggacaagggcaacagacggatcagcagcttctggcaggacttcatcctgcagacctacatccagggcaacaagggcagcaagcggatgagccctaaacaggtggccattagagtgcaggccaaggccagcgagatcaaggacaacaagcctcctagctacaagaccgtgctgcggctgctgaagcccatccagaagaagaaagagcggaccatcagaagccctggctggcagggaacaaccctgagcgtgaaaaccagagatggccaggacatccagatcaaccacagcaatcaagtgtggcagtgcgatcacaccctggtggatgtgctgctggtggatagacacggcgagctgattggcagaccttggctgaccaccgtggtggacagctacagcagatgcgtgatgggcatcaacctgggcttcgatgcccctagctctctggtggttgctctggccctgagacacagcatcctgcctaagaactactcccaggatttccagctgtactgcgactggggcgtgttcggactgcctgagtgcctgtttacagacggcggcaaggacttccggtccaaccatctggaagagatcgccacacagctgggcttcatccggaagctgagagacagacctagcgaaggcggcatcgtggaaagacccttcaagaccctgaatcagagcctgttcagcaccctgcctggctacacaggcagcaacgtgcaagagaggcctaaggacgccgagaaggatgccagactgaccctgagagatctggaaatgctgatcgtgcggttcatcgtggacaagtacaaccagagcacaatcgccggcaaggatgagcagacccggtatcagagatgggaggccggactgatcaaggatcccaagatcatcagcgagagagagctggacatctgcctgatgaagtctaagcggcggacagtgcagagaggcggccatctgcagttcgagaacatcatctaccggggcgagtacctggccggctatgagggcgatattgtgaacgtgcggtacaaccccatcaacatcaccaccatcctggtgtatcggcgcgagcagggcaaagaggtgttcctgacaagagcccacgctctcggatgggagacagagatccacagcctgtctgaggccagagccagcgtgaagagactgagacaggccaagaagaagatcagcaacgagtccatccaccaagagatcctgctgagggacagcgccgtggataagaagaagtccagaaagcagcggcagaaagaggaacagagctacaagctgatcacaagccccaaggtggtggcccaggatatcgagtctcaagagatcgagcgggacatctccgccgagatcgctgatgtggaagtgtgggacttcgacgaactcgaggacgagtga

SEQ ID NO: 1163 - DNA, 852 bp, Myxosarcina species
atggtcacagaggccaaggccattgccgacaagctgggcaagatcgagctggacgaagagtgggtgcagaaagagatcgcccggctgaaccggaagtctacagtggccctggaacacatcaaagagctgcacgactggctggacggcaagagaaagagcagacggtcctgcagaatcgtgggcaagagcagaaccggcaagacagtggcctgtgaagcctacgtgatgcggaacaagctgaacaagcctcctcaagagcggcagaccaagaatcagatccccatcgagcccgtgatcatgattatgcctccacagaagtgcggcgccaaagaactgttccgcgagatcatcgagtgcctgaagttcagagccgtgaagggcaccatcagcgagttcagatccagagccatggacgtgctgcagaaatgccaggtggaaatgctgatcatcgacgaggccgaccggctgaagcctgagacattttccgaagtgcgggacatctacgacaagctcgagatcgccgtggtgctcgtgggcaccgaaagactggataccgccgtgaagagagatgagcaggtcgagaacagattccgggccaacagaagattcggcaccctggaaggcatcaacttcaagaaaaccgtcgagatctgggaagagaagatcctgaagctgcccgtggccagcaacctgaccaacaagaccacctggaagattctgctgatcgccaccgagggcttcatcggcagactggacgagattctgagagaggccgctatcgccagcctgtctcagggacacaagaaggtggaccccaaaatcctgaaagagattgccagagagtacagctga

SEQ ID NO: 1164 - DNA, 423 bp, Myxosarcina species
atgaacaacaccaaagaggcccagctctggctgttccccgtggaaccttctaatggcgagagcctgagccacttcctgggcagattcaggcggagcaaccacctgtctccaagcgctctgggagatctggctggaattggcggagtggtggccagatgggagagattccacctgaatccatttccaaccgacgagcagtttcaggccctggccgaagtggtggatgtggatagcagcaccctgagagagatgctgcctcctaaaggcaccggcatgaagtgcgaccggcacaacctgaagctgatctccaagtgtcccaactgccgggccaagttcaagatgcctgctctgtgggagtacggctgctgccacagatgcagactgccttttgccgctatcgcccagtaccagcagagcgtgtaa

SEQ ID NO: 1165 - DNA, 1848 bp, Myxosarcina species
atgagccagaacgccatccagtgcagactgatcgcccctgagacaacccgtagacagcagtggcagctgatggccgagaagaacacccctctgatcaacgagctgctgaagcagctggccgagcatcctgagctggaaacctggaagcggaagggcaagatccctcctggcaccgtgaagaacctgtgccagcctctgagaacctgtcctcagtacatcaaccagcctggccggttctacagcagcgtgatctctctggccgagtacatctacagaagctggctgaagctgcagcggcggctgatcttcagactgaacggacagcagcggtggctgcagatgctgaagtccgatgaagaactggtggccgagagcggcagaagcctgaaagagattgaggccaaggccagcgaggccctggacaggctgaacagagaggaaaaccccagcatcagcaaccggctgttcgacctgtacgacgagacagaggacatcctgatccgcagcgccatcgtgtacctgctgaagaacggctgcaagatcagacagaagcccgaggatcccaagaagttcgccagacggcggagaaagaccgagatcagagtgaagagactgcaagagaagctgaacggcaaggcccctcagggcagagatctgacaggcgagaaatggctgaacaccctgttcaccgccaccagccaggtgccacaggatgaagcccaggccaagagctggcaggacattctgctgaccaagagcaagctggtgccctatcctatcgtgtacgagagcaacgaggacctgacctggtccaagaacgagaggggcagactgtgcgtgaagttcaacggcctgagcgaccacaccttccagatctactgcgacagacggcagctgaagatctttaacaggttctacgaggaccagcagatcaagaaggccagcaagaacagccacagcagcgccctgtttaccctgagatctgccacaatcgcctggcaagaaggcaaaggcaagggcgagccctggaacgtgaaccggctgatcctgtactgcaccttcgacaacctgctgctgacaaccgagggcacagaggttgtgcggcaagagaaagccgaggccattgccaacacactcaccaagatcaaagagaagggcgacctgaaccagaagcagcaggccttcatccggcggaaagagacaagcctgagccggatcaacaacccatttcctcggcctagcagacccctgtacaagggcaagtccaacatcctgctgggcgtcgccatcagactggataagcctgccacagtggccatcgtggatggcgccacagataaggctatcgcctacctgagcaccaaacagctgctgggcaagaactaccatctgctgaaccggaagagacagcagcagcacatcctgtctcaccagagaaacgtggcccagagacaccacgccaacaacaagtttggcgagagcgagctgggccagtacatcgatagactgctggccaaagccatcatccagctggccaaggactacagagtgggcagcatcgtggtgccttacatggaagatacccgcgagatcatccaggccgaggtgcaggctagagccgaggctaagatccctggctgcatcgagaagcagaaagagtacgccaagaagtaccggaccaacatccacaagtggtcctacggcaggctgatcgatctgatcaaggcccaggccgccaaggccggaatcgtgatcgaggaaagcaagcagagcatccggggcgaccctaagaagcaggccaaagaaattgccgtgtgcgcctaccgggacagaatcgtgcctttctga

SEQ ID NO: 1166 - DNA, 512 bp, Myxosarcina species
gagtgtcaatttaagaattttcaagcacataacttctgtacctcgaaaattaaatataatttttaataaatcaaatataatttttaataaatcgcgccgtagatcatgttcttttagaaccgctgaactatgttaaatgtgggttagttttactgtcggcaggcagaatgctttctgtccctggtagctgtccgccctgatgctgccatcgaaaagatgggaataaggtgcgcccccagcaataagtggtgtagacgtactacagcgatcgctaccgaatcacctccgagcaaggaggagtctatcctcattttttctcttttttgacgaacccaagcgtgggcaaaattcttagggggttcgacaaaactgcaaaagtcaagcctgacaagcttttgatacttttaacgaagtggtttttactgtaatgcaacaaaaaatagagaattctttcttaggtttgtcaaaattgaccctggagatgagtcttaataactatttcagcttacaga

SEQ ID NO: 1167 - DNA, 37 bp, Myxosarcina species
gtttcaacgaccactttaagatgggtatggttgaaag

SEQ ID NO: 1168 - DNA, 564 bp, Myxosarcina species
  misc_feature (541)..(564): n is a, c, g, or t
gagtgtcaatttaagaattttcaagcacataacttctgtacctcgaaaattaaatataatttttaataaatcaaatataatttttaataaatcgcgccgtagatcatgttcttttagaaccgctgaactatgttaaatgtgggttagttttactgtcggcaggcagaatgctttctgtccctggtagctgtccgccctgatgctgccatcgaaaagatgggaataaggtgcgcccccagcaataagtggtgtagacgtactacagcgatcgctaccgaatcacctccgagcaaggaggagtctatcctcattttttctcttttttgacgaacccaagcgtgggcaaaattcttagggggttcgacaaaactgcaaaagtcaagcctgacaagcttttgatacttttaacgaagtggtttttactgtaatgcaacaaaaaatagagaattctttcttaggtttgtcaaaattgaccctggagatgagtcttaataactatttcagcttacagagaaactttaagatgggtatggttgaaagnnnnnnnnnnnnnnnnnnnnnnnn

SEQ ID NO: 1169 - DNA, 500 bp, Myxosarcina species
cgctagtacattccagcgtcctatcaacagaagtagaattccctgaatgatgccactaattccactattaataggaacctcttctttttgaataaatatgtacggtgactaattatttgacataatgacaaattgttgtcatgcaattcaaagctttatatgctaggcatcatagcatttttattataatatttgattgacttatataatgacaaacaaaatgtcgtttgtttgcaaaatgactaattagctgtcgtttattgaaaattcagttttaaagaaaagtgacaagatctgtgtcacttttttatttaaatatagaattacattatgtgttttttaaaaaaactaatttactaaaatgaatagtgaaagcacttccgaaacaaattcaaaattagctatatctgatttggaagacgaccgagaaatagtcattacttctcagctagaaggaaaagcaaaagagagactggaggtcattcaaagtttgctcgaac

SEQ ID NO: 1170 - DNA, 500 bp, Myxosarcina species
gtttcaatgaccattttgtgatggcttgggttgaaagataaaggcttagtcattgttattgatgaagcggaagtgccaacgaccacacgcaaattttaattctcaataactatcgtctaattctcgctaagaaactgaaagtaattttaaagtcttgttctttggttactccaagtaatttattacttttaggcgatcgccttgcttgccgagtttaatttgtatcagcaattgctgtatacagtctaaaaccaagtaaattcgattaattattttttgtgcgacgcagtaagtcgcttgatttaagtgaaaatttcatgactgaggttatggatttctagtagatttcatcctactattcccacgtaaaggagtctcgtactctggtcacattgaaagtaaataatgaactcaatggaatgcagaccatgaatgtatccgaaggtggataacctctatccagctagggctagggaaaagttggaagggttaatgtaaat

SEQ ID NO: 1171 - DNA, 1743 bp, Nostoc species
atggacgagatgcccatcttcaaccagaacgacgagagcctgctgttcgagaacaacgccgacatcgacgagatccaggacgacgagtccgaggaagccaacctgatcttcacagagctgagcgccgaggccaagatcaagatggaagtgatccagggcctgttcgagccctgcgacagaaagacatacggccagaagctgagaacagccgccgagaagctgggaaagacagtgcggacagtgcagcggctggtcaagaagtatcagcaggacggcctgagcgccatcgtggacacccagagaaatgacaagggcagctaccggatcgaccccgagtggcagaagttcatcatcaccaccttcaaagagggcaacaagggctccaagaagatgacccctgctcaggtggccatgagagtgcaagttcgggctgaacagctgggcctgaagaaataccccagccacatgaccgtgtaccgggtgctgaaccccatcatcgagcggcaagagcagaagcagaaacagcggaacatcggctggcggggctctagagtgtctcacaagaccagagatggccagacactggacgtgcggtacagcaatcacgtgtggcagtgcgaccacaccaagctggatgtgatgctggtggaccagtacggcgagcctcttgctagaccttggctgaccaagatcaccgacagctacagccggtgcatcatgggagtgcacgtgggctttgatgcccctagctctcaggttgtggccctggctctgagatacgccatcctgcctaagcagtacagcgccgagtacaagctgctgagcgagtggcggacatctggcatccccgagaacctgtttaccgacggcggcagagacttcagaagcgagcacctgaagcagatcggcttccagctgggcttcgagtgtcacctgagagacagacctagcgaaggcggcatcgaggaaagaagcttcggaacaatcaataccgagttcctgagcggcttctacggctacctgggcagcaacatccaagagagatccaagaccgccgaggaagaggcctgtctgacactgagagagctgcatctgctgctcgtgcgctacatcgtggataactacaaccagaggctggacgcccggaccaaggaccagaccagatttcagagatgggaggccggactgcccgctctgcctaagatggttcgagagcgcgagctggacatctgcctgatgaagaaaacccggcggagcatctacaaaggcggctatctgagcttcgagaatatcatgtaccggggcgactacctggccgcctatgccggcgaaaacatcgtgctgagatatgaccccagagatatcaccaccgtgtgggtgtacagaatcgagaagggcaaagaggtgttcctgtccgccgctcatgccctggattgggagacagaacagctgtccctggaagaagccaaggccgcctctagaaaagtgcggagcgtgggcaagaccctgaccaacaagtctatcctggccgagatccacgacagagacacctttatcaagcagaagaagaagtcccagaaagagcgcaagaaagaggaacaggctcaggtccacagcgtgtacgagcccatcaacctgagcaagaccgagcctctggaaaacctgcaagagacacccaagcctgagacacggaagccccgggtgttcaactacgagcagctgagacaggactacgacgagtga

SEQ ID NO: 1172 - DNA, 837 bp, Nostoc species
atgaaggacgactactggcagaagtggatccagaacctgtggggcgacgagcccattcctgaagaactgcagctggaaatcgagcggctgctgacacctagcgtggtggaactggaacacatccagaagatccacgactggctggacggcctgagactgtctaagcagtgcggcagaattgtggcccctcctagagccggcaagagcgtgacatgtgacgtgtacagactgctgaacaagccccagaagagaggcggcaagcgggatattgtgcccgtgctgtatatgcaggtccccggcgattgctctagcggagaactgctggtgctgatcctggaaagcctgaagtacgatgccaccagcggcaagctgaccgacctgagaagaagagtgcagaggctgctgaaagaaagcaaggtggaaatgctgattatcgacgaggccaacttcctcaagctgaacaccttcagcgagatcgcccggatctacgacctgctgagaatcagcatcgtgctcgtgggcaccgacggcctggacaacctgatcaagaaagagccctacatccacgaccggttcatcgagtgctacaggctgcctctggtgtccgagaagaaattccccgagctggtcaagatctgggaagaagaggtgctctgcctgcctctgcctagcaatctgatccggaacgagacactgctgcccctgtaccagaaaaccggcggcaagatcggcctggtggatagagttctgcggagagcctctattctggccctgagaaagggcctgaagaatatcgacaaggacaccctggccgaggtgctggattggttcgaatga

SEQ ID NO: 1173 - DNA, 504 bp, Nostoc species
atggaaatcggagccgaggaaccccggttcttcgaggtggaacctctgaatggcgagagcctgagccacttcctgggcagattcagaagagagaactacctgaccagcagccagctgggcaagctgacaggactgggagccgtgatcagcagatgggagaagctgtacttcaacccatttccaaccaggcaagagctggaagccctggccacagtcgtcagagtgaacgccgatagactgaccgagatgctgcctctgaagggcgtgaccatgaagcccagacctatcagactgtgcgccgcctgctatgccgagtatccctgtcacagaatcgagtggcagttcaaggacaagatgaagtgcgaccggcacaacctgcggctgctgaccaagtgcatcaactgcgagacaccctttcctatacctgccgactgggtggaaggcgagtgcagccactgctttctgccttttgccaccatggccaagcggcagaaaagccggtaa

SEQ ID NO: 1174 - DNA, 1908 bp, Nostoc species
atgagcgtgatcaccatccagtgcagactggtggccgaggaagagacactgtctcagctgtgggagctgatggccgacaagaacacccctctgatcaacgagctgctggcccaagtgggcaagcaccccgattttgagacatggctggaacagggcaagatccccacagagctgctgaaaaccctggtcaacagcctcaagacccaagagagattcgccggccagcctggcagattctacacaagcgccattgccatcgtggactacgtgtacaagagttggttcgccctgcagaagcggcggaagcaccagatcgagggcaaagagagatggctgaccatcctgaagtccgaccagcagctggaacaagagtcccagtgcagcctgaacgtgatccggacaaaggccatcgagatcctgagccagttcacccctcagagcgaccagaacaagaaccagcggaagtctaaaaagaccaagaagtccgccaagctgcacaagagcagcctgtttcagatcctgctgaacacctacgagcagacccaggatcctctgaccagatgtgccgtggcctacctgctgaagaacaactgccagatctccgagctgcacgaggaccccgagaagttcaccagaaaccggcggaagaaagagatcgagatcgagcggctgaaggaccagctgcaaggcagacttcccaagggcagagatctgaccggcgaagagtggctggaaacactggaaatcgccaccgacaacgtgccccagaacgagaatgaagccaaggcctggcaagccgctctgctgagaaaatctgccgaggtgccatttcctgtggcctacgagagcaacgaggacatgacctggctgaaaaacgataagggcagactgttcgtgcggttcaacggcctgggcaagctgaccttcgagatctactgcgacaagcggcatctgcactacttccagcgctttctggaagatcaagagatcaagcggaacagcaagaatcagtacagcagctccctgttcaccctgcggagtggtagactggcttggctgcctggcgaggaaaaaggcgagccctggaaagtgaatcagctgcacctgtactgcgccctggacaccagaatgtggaccacagagggcacccagaaagtcatcaacgagaagtccatcaagatcaccgagacactgaccaaggccaagcagaaagaggacctgaacgacaagcagcaggccttcatcaccagacagcagagcaccctggaccggatccacaatccatttccacggcctagcaagcccaactaccagggccagccttctatcctcgtgggcgtgtcctttggcctggaaaagcctgtgacagtggccgtggtggacgtggtcaagaatgaggtgctggcctacagaagcgtgaagcagctcctgggaaagaactacaatctgctgaaccggcagcgccagcagcagcagagactgtctcacgagagacacaaggcccagaagcagaacgcccctaacagctttggcgagtctgagctgggccagtacgtggacagactgctggctgatgccattgtggctatcgccaagagctatcaggctggcggcatcgtgatccccaaactgcacgacatgagagagcagatcagcagcgagatccagagcagagccgagaacaagtgccccggctacaaagaggcccagcagaagtacgccaaagaataccggatgagcgtgcaccggtggtcctacggcagactgatcgacagcatcaagagccaggccgccaaagtgggcatcagcacagagatcggcacccagcctatcagaggcagccctcaagagaaggctcgcgatctggccgtgttcacctaccaagaaagacaggccgctctgatctga

SEQ ID NO: 1175 - DNA, 494 bp, Nostoc species
ctcactaatccgaaccttgaaaatataatatttttataacagcgccgcagttcatgctcttttgagccaatgtactgtgaaaaatctgggttagtttggcggttgtcagaccgtcatgctttctgaccctggtagctgcccgcttctgatgctgccatctttagaattctatagatgggataggtgcgctcccagcaataggaagtaggcttttagctgtagccgttatttatgacggtgtggactaccacagtggtggctactgaatcacccccttcgtcgggggaaccctcccaaatatttttttggcgaatcaaagcggggtcaaaaaccctggagacttgccaaactctgaaaacccttgtcatgtattgaattaagaaattagtgtgtcaactgatttatttttttcattgtcatcaaaaccagctttttaacagacttgtcaaatagacatctgaaacgcttgtataacaagggcctaagcgggaaca

SEQ ID NO: 1176 - DNA, 37 bp, Nostoc species; identical to SEQ ID NO: 819

SEQ ID NO: 1177 - DNA, 546 bp, Nostoc species
  misc_feature (523)..(546): n is a, c, g, or t
ctcactaatccgaaccttgaaaatataatatttttataacagcgccgcagttcatgctcttttgagccaatgtactgtgaaaaatctgggttagtttggcggttgtcagaccgtcatgctttctgaccctggtagctgcccgcttctgatgctgccatctttagaattctatagatgggataggtgcgctcccagcaataggaagtaggcttttagctgtagccgttatttatgacggtgtggactaccacagtggtggctactgaatcacccccttcgtcgggggaaccctcccaaatatttttttggcgaatcaaagcggggtcaaaaaccctggagacttgccaaactctgaaaacccttgtcatgtattgaattaagaaattagtgtgtcaactgatttatttttttcattgtcatcaaaaccagctttttaacagacttgtcaaatagacatctgaaacgcttgtataacaagggcctaagcgggaacagaaatcccggctaggggtgggttgaaagnnnnnnnnnnnnnnnnnnnnnnnn

SEQ ID NO: 1178 - DNA, 500 bp, Nostoc species; identical to SEQ ID NO: 820

SEQ ID NO: 1179 - DNA, 500 bp, Nostoc species; identical to SEQ ID NO: 821

SEQ ID NO: 1180 - DNA, 1857 bp, Nostoc species
atgcccgacaaagagtttggactgaccggcgagctgacccaagtgaccgaggccatctttctgggcgagagcaacttcgtggtggaccctctgcacatcatcctggaaagcagcgacagccagaagctgaagttccacctgatccagtggctggccgagtctcccaacagacagatcaagagccagcggaagcaggccgtggctgatacactgggagtgtccaccagacaggtggaaagactgctgaaagagtacaacgaggaccggctgaacgagacagctggcgtgcagagatctgacaagggccagtacagagtgtccgagtactggcaagagtacatcaagaccacctacgagaacagcctgaaagaaaagcaccctatgagccccgccagcgtcgtgcgggaagtgaaaagacacgccatcgtggatctgggcctcgagcagggcgattatcctcatcctgccaccgtgtaccggatcctgaatcctctgatcgagcagcagaaactgaagaagaagatcagaaaccccggcagcggcagctggctgaccgtggaaacaagagatggcaagcagctgaaggccgagttcagcaaccagatcatccagtgcgaccacaccgagctggacatccggatcgtggacaacaatggcgtgctgctgcccgaaagaccttggctgacaaccgtggtggataccttcagcagctacgtgctgggctttcacctgtggatcaagcagcctggaagcgccgaagttgccctggctctgagacacagcatcctgcctaagcagtacagccacgactacgagctgagcaagccttggggctacggccctccattccagtactttttcaccgacggcggcaaggacttcagatccaagcacctgaaagccatcggcaagaaactgggatttcagtgcgagctgcgggacagacctaatcaaggcggcatcgtggaacggatcttcaagaccatcaacacacaggccctgaaggacctgcctggctacacaggcagcaacgtgcaagagaggcctgagaacgccgagaaagaagcctgcctgaccatccaggacatcgacaaagtgctggccggcttcttctgcgacatctacaaccacgagccttatcctaaggaccccagagacaccagattcgagcggtggttcaaaggcatgggcggcaagctgcctgagcctctggatgagagagagctggatatctgcctgatgaaagaaacccagagagtggtgcaggcccacggcagcatccagtttgagaacctggtgtacagaggcgagagcctgagagcctacaagggcgagtatgtgaccctgagatacgaccccgaccacatcctgacactgtacgtgtacagctgcgacgccaacgacgacctgggcgattttctgggatatgtgcacgccgtgaacatggacacccaagagctgtccctggaagaactgaagtccctgaacaaagagcggaacaaggccctgagagagcactgcaattacgacgccctgctggccctgggcaagagaaaagagctggtcaaagagcgcaagcaagagaagaaagagatccggcaggccgaacagcagaggctgagaagcggcagcaagaaaaactccaacgtggtggaactgagaaagagccgggccaagaactacctgcggaacaacgagcctatcgaggtgctgccagagcgggtgtccagagaagagatccaggtgcagaaaaccgaggtgcagatcgaggtgtccgaacaggccgacaacctgaagcaagaacggcaccagctcgtgatcagcagacggaagcagaacctgaaaaacatctggtga

SEQ ID NO: 1181 - DNA, 855 bp, Nostoc species
atggctcagtcccagctggccatccagcctaacgtggaagttctggcccctcagctggacctgaacaaccagctggctaaagtgatcgagatcgaggaaatcttcagcaactgcttcatccccaccgaccgggccagcgagtacttcagatggctggacgagctgcggatcctgaagcagtgtggcagagttgtgggccccagagatgtgggcaagagcagaacaagcgtgcactacagagaagaggaccggaagaaagtgtcctacgtcagagcttggagcgccagcagcagcaagagactgttcagccagattctgaaggacatcaaccacgccgctcctaccggcaagagagaggatctcagacctagactggccggcagcctggaactgttcggaatcgagcaagtgatcgtggacaacgccgacaacctgcagagagaggctctgctggatctcaagcagctgttcgacgagagcaacgtgtccgtggtgctcgttggaggccaagagctggacaagatcctgtacgacttcgacctgctgaccagctttcccacactgtacgagtttgaccggctggaacaggacgacttcctgaaaaccctgagcaccatcgagttcgacgtgctggctctgcctgaggccagcaatctgtgcaagggcatcaccttcgagatcctggccgagacaacaggcggcagaatgggcctgctggttaagatcctgaccaaggccgtgctgcacagcctgaagaatggcttcggcagagtggaccagggcatcctggaaaagatcgccaacagatacggcaagcggtacatccctcctgagaaccggaacaagaacagctga

SEQ ID NO: 1182 - DNA, 561 bp, Nostoc species
atggccagagacacctttccacctaagatcgagatccgcatccacgacaaccacgaggccctgctgagactgggctacgtggacccttatgagggcgagagcatcagccactacctgggcagactgcggagattcaaggccaacagcctgcctagcggctacagcctgggaaagatcgccggaattggcgccgtgaccaccagatgggagaagctgtacttcaacccatttccgagcaacaaagagctggaagccctgggcaagctgatctgcctgcctaccaaccggatctacgagatgctgcctcctaagggcgtgaccatgaagcccagacctatcagactgtgcgccgcctgttatgccgaggtgccctgtcacagaatcgagtggcagtacaaggacaagatgaagtgcgaccggcacaacctgcggctgctgaccaagtgcaccaactgcgagacaacattccccattccagccgactgggtgcagggcgaatgccctcactgctttctgccctttccaatgatggtcaagcggcagcggcagctgagcaactaa

SEQ ID NO: 1183 - DNA, 1911 bp, Nostoc species
atgagcatcatcaccatccagtgccggctggtggccgaggaagaaacactgagacagctgtgggagctgatgaccgacaagaacacccctctggtcaacgagctgctggcccaagtgggaaagcaccccgatttcgagacatggctggaaaagggcaagatccccacagagctgctgaaaaccctggtcaacagcctcaagacccaagaaagattcgtgggccagcctggccggttctacacatctgctattgccctggtggactacgtgtacaagagttggttcgccctgcagaagcggcggaagagacagatcgagggcaaagagagatggctgaccatcctgaagtccgacatccagatcgagcaagagagccagagcaccctgaacgtgatcaggaccaaggccaccgagatcctgaccaagttcacccctcagagcgagcagaaccacaaccagagaaagagcaagcggaccaagaagaagtccaccaacagcaagaagtctagcctgttccagatcctgctgaacacctacgaggaaacccaggacaccctgaccagatgtgccctggcctacctgctgaagaacaactgccagatcagcgagctggacgaggaccccgaggaattcaccagaaagaagcgcaagaaagagatcgagatccagcggctgaaggaccagctgcagagcagaatccccaagggcagagatctgaccggcgaagagtggctcgagacactggaactggccagagccaacgtgccccagaatgagaaagaggccaaagcctggcaggccgctctgctgagaaaaagcgccgacgtgccatttcctgtggcctacgagagcaacgaggacatgacctggtggcagaacgataagggcagactgttcgtgcggttcaacggcctgggcaagctgaccttcgagatctactgcgacaagcggcatctgcactacttcaagcggtttctcgaggaccaagagatcaagcggaactccaagaaccagtacagcagcagcctgttcaccctgagatccggcaggctttcttggaggcctggcgaggaaaaaggcgagccctggaaagtgaatcagctgcacctccattgcgccctggccaccagaatgtggacaaccgagggaacacagcaggtcgtgaacgagaaaaccaccaagatcaccaagacactgacccaggccaagcagaagaacgagctgaacgaaaagcagcaggccttcatcacccggcagcagagcacactggaccggatcaacaacccatttccacggcctagcaaggccaactaccagggccagtctagcatcctcgtgggcgtgtcctttggcctggaaaagcctgtgacaatcgccgtggtggacgtggtcaagaatgaggtgctggcctacagaagcgtgaaacagctgctgggcaagaactacaatctgctgaaccggcagcggcagcagcaacagagactgtctcacgagagacacaaggcccagaaacagaacgtgcccaacagcttcggcgagtctgagctgggccagtacgttgacagactgctggccgacgccatcattgccattgccaagacataccaggccggcagcatcgtgatccccaagctgagagacatgagagagcagatcagcagcgagattcagagcaaggccgagaagaagtgccccggctacaaagaggcccagcagaaatacgccaaagaataccggatgaccatccacagatggtcctacggcagactgatcgagagcatcaagtcccaggccgccaaggccggaattcctacagagattggcacccagcctatccggggcagccctcaagaaaaggctagagatctggccgtgctggcttatcaagaaagacaggtggccgtgatctga

SEQ ID NO: 1184 - DNA, 493 bp, Nostoc species
ttcactaatccgaaccttgaaaatataatatttttataacagcgccgcagttcatgcttttttgagccaatgtactgtgaaaaatctgggttagtttggcggttggaagaccctcatgctttctgaccctggtagttgcccgcttctgatgctgccatctgtagaattctatagatgggataggtgcgctcccagcaataaggagtaaagcttttagctgtagccgttatttataacggtgtggattaccacagggtggctactgaatcacccccttcgtcgggggaaccctcccaaatatttttttggcaaatcgaagcggggtcaaaaaccctggggacttgccaaagtcggaaaacccttgtcctgtgttgaataaagaagttatcgcgttaattgatttactctttttattgtcagcagaagcagctttttcatagacttgtcaattagacatctgaaaagcttgtataacaaggctctaggcgggaac

SEQ ID NO: 1185 - DNA, 37 bp, Nostoc species; identical to SEQ ID NO: 819

SEQ ID NO: 1186 - DNA, 545 bp, Nostoc species
  misc_feature (522)..(545): n is a, c, g, or t
ttcactaatccgaaccttgaaaatataatatttttataacagcgccgcagttcatgcttttttgagccaatgtactgtgaaaaatctgggttagtttggcggttggaagaccctcatgctttctgaccctggtagttgcccgcttctgatgctgccatctgtagaattctatagatgggataggtgcgctcccagcaataaggagtaaagcttttagctgtagccgttatttataacggtgtggattaccacagggtggctactgaatcacccccttcgtcgggggaaccctcccaaatatttttttggcaaatcgaagcggggtcaaaaaccctggggacttgccaaagtcggaaaacccttgtcctgtgttgaataaagaagttatcgcgttaattgatttactctttttattgtcagcagaagcagctttttcatagacttgtcaattagacatctgaaaagcttgtataacaaggctctaggcgggaacgaaatcccggctaggggtgggttgaaagnnnnnnnnnnnnnnnnnnnnnnnn

SEQ ID NO: 1187 - DNA, 500 bp, Nostoc species
tttcaaattcacttaattaaacctgttgaacaaccacaattgctaaatgcgatcaggcaaattttggctaacttagattaattcttaattaacgtgtacattcgcacattatatgtcgcaattcgcaaaaaacgacatgagcgtctttatcatctaaaacgcttatcatataaagctttcaggacattgttgactaaaaatacaaaattccttaattcgcacattaaatgtcgttagaactgaaatttgcaaattaatgtcgtttatttaaattttgccacattgcaaattcaatgtcgcattttctttagttaatggtacattaatactaccaataactacattctccttgcttaaatgccagacaaagaatttggattaaccggagaattgacacaagttacggaagctattttccttggtgaaagtaattttgtggtcgatccattacacattattctggaatcctcagatagccagaaactcaaatttcatctcat

SEQ ID NO: 1188 - DNA, 600 bp, Nostoc species
agtttcaacaaccggctaggggtgggttgaaagcaccgtaagcactccacttacatctgagttgcttatcagggtttcaacaaccatcccggttaggggtgggttgaaaggacaataattatttaataagccacaagctttcgcagggttcaacaaatattgaggttatggcagttttgcaaaaacaagcatatagagattatttattcgcattaaccaggttttaaaatagttaaagggtatacatgaattattaggagggttgaaaggagcgctgcgatcggacaaaattcaatgaggaaataattcgcttgcggtaaacttgacagctaatgactaaacaatacgacgttaatttgcgaaacgttaatataaccgaattagtggcacgaattagggaaagcgacattaatgtgcaaacaacgacaccaatttgcgaagaacgacatataatgtgcgaatgtacagtacaaatggagaatagggaactcgaatccctgacctctgcggtgcgatcgcagcgctctaccaactgagctaattccccttaaaatggttgttgctgagttaatcaaattactagcaattcaatcaacgctc

SEQ ID NO: 1189 - DNA, 1683 bp, Trichormus variabilis
atgctggacgaccccgacaagggcaatcaagagcctgagacacacgagatcgtgaccgagctgagcctggacgaacagcatctgctggaaatgatccagaagctgatcgagccctgcgaccggatcacatacggcgagagacagagagaggtggccggcaagctgggaaagtctgtgcggacagttcggcggctggtcaagaagtgggagcaagaaggactgacagccctgcagacagccaccagaaccgataagggcacccacagaatcgacagcgactggcaggacttcatcatcaagacctacaaagagaacaacaaggacggcaagcggatgagccccaaacaggtggcactgagagtgcagaccaaggccgaagaactgggccagcagaagtaccccagctaccggacagtgtacagagtgctgcagcccatcatcgagcagaaagagcaaaaagagggcatcagacacagaggctggcacggctctagactgagcgtgaaaaccagagatggcaaggacctgttcgtggaacacagcaaccacgtgtggcagtgcgaccacaccagagtggatctgctgctggtggatcagcacggcgagctgctttctagaccctggctgaccatcgtggtggacacctactccagatgcatcatgggcatcaacctgggcttcgacgcccctagctctcaagtgattgctctggccctgcggcacgccatcctgcctaagagatacggctctgagtacggcctgcacgaggaatggggcacctatggaaagcccgagcacttctacaccgacggcggcaaggacttcagaagcaaccatctgcagcagattggcgtgcagctgggctttgtgtgtcacctgagagacaggcctagcgaaggcggcatcgtggaaagacctttcggcaccttcaacaccgacctgttcagcaccctgcctggctacacaggcagcaacgtgcaagagaggcctgagcaggccgagaaagaggcctgtatcaccctgagagagctggaaagactgctcgtgcggtacatcgtggacaagtacaaccagagcatcgacgccagactgggcgatcagacccggtatcagagatgggaggccggactgatcgtggcccctaacctgatcagcgaggaagaactgcggatctgcctgatgaagcagacccggcggagcatctacagaggcggctatgtgcagttcgagaacctgacctaccggggcgaaaatctggccggatatgccggcgagaacgtggtgctgagatacgaccccaaggacatcaccacactgctggtgtaccggcagaagggaaatcaagaagagttcctggccagagcctacgctcaggacctggaaacagaggaactgtctgtggacgaggccaaggccatgagcagaagaatcagacaggccggaaaggccatcagcaaccggtctattctggccgaagtgcgggaccgcgagacattcgtgaaccagaaaaagaccaagaaagagcgccagaaggccgagcagacaatcgtgcagaaagccaagaaacccgtgcctgtggaacccgaggaagagatcgaagtcgcctccgtggatagcgagcccgagtatcagatgcccgaggtgttcgactacgagcagatgcgcgaggactacggctggtaa

SEQ ID NO: 1190 - DNA, 837 bp, Trichormus variabilis
atgacaagcaagcaggcccaggctgttgctcagcagctgggagacatccccgtgaacgacgagaagatccaggccgagatccagcggctgaacagaaagagcttcatccctctggaacaggtgcagatgctgcacgactggctggacggcaagagacagagcagacagtctggcagagtcgtgggcgagagcagaaccggcaagaccatgggctgtgacgcctacagactgcggcacaagcctaagcaagagcccggcagacctcctacagtgcccgtggcctatatccagattcctcaagagtgcggcgccaaagaactgttcggcgtgctgctggaacacctgaagtaccagatgaccaagggcaccgtggccgagattagagacagaaccctgcgggtgctgaaaggctgcggagtggaaatgctgatcatcgacgaggccgaccggctgaagcctaagacatttgccgaggtgcccgacatcttcgacaagctggaaatcgccgtgatcctcgtgggcaccgatagactggatgccgtgatcaagcgggacgaacaggtgtacaaccggttcagagcctgccacagattcggcaagtttagcggcgacgagttcaagaaaatcgtggacatctgggagaagaaggtgctgcagctgcctgtggccagcaacctgagcagcaagacaatgctgaaaaccctgggcgagacaaccggcggctatatcggactgctggacatgatcctgagagagagcgccatcagagccctgaagaaaggcctgagaaaggtggacctggccacactgaaagaagtgaccgaagagtacaagtga

SEQ ID NO: 1191 - DNA, 504 bp, Trichormus variabilis
atggaagtgccccagatccagccttggctgttccagatcgaacccctggaaggcgagagcctgtctcacttcctgggcagattcagacgggccaacgatctgacaccaaccggcctgggaaaagccgctggacttggcggagctattgccagatgggagaagttccggttcaaccctccacctagccggcagcaactggaagccctggccaatgtcgtgggagtcgatgccgatagactggcccagatgcttccttctgctggcgtgggcatgaagatggaacccatcagactgtgcgccgcctgctatgccgaatctccctgtcacaagatcgagtggcagttcaaagtgacccggggctgcgccagacacaagatcacactgctgagcgagtgccccaactgcaaggccagattcaaggtgccagctctgtgggtggacggctggtgcaacagatgctttctgagattcgaggaaatggccaagtaccagaaaggcctgtga

SEQ ID NO: 1192 - DNA, 1929 bp, Trichormus variabilis
atgagccagatcaccatccagtgcagactggtggccagcgagccttctagacaccagctgtggaagctgatggtggacctgaacacccctctgatcaacgagctgctggtgcaggttgcccagcatcctgagtttgagacatggcggcagaagggcaagcaccccgccaagattgtgaaagagctgtgcgagcccctgcggacagaccccagattcattggacagcccggcagattctacaccagcgccattgccaccgtgaactacatctacaagagttggttcgccctgatgaagcggagccagtctcagctggaaggcaagatgcgttggtgggagatgctgaagtccgacgccgagctggtggaagtgtctggcgtgacactggaaagcctgagaacaaaggccgccgagatcctgagccagtttgcccctcagcctgacaccgttgaagcccagcctgccaagggcaagaagcggaaaaagaccaagaagtctgacggcgactgcgccgagagaacactgagagagagatccatcagcgactacctgttcgaggcctaccgggacaccgaagagattctgaccagatgcgccatcaactacctgctgaagaacggctgcaagatcagcaacaaagaggaaaacgccgagaagttcgccaagcggcggagaaagctggaaatccagatcgagcggctgcgcgagaagctggaagccagaattcccaagggcagagatctgaccgacgccaagtggctggaaaccctgctgctggccacactgaacgtgccagagaatgaggccgaggccaagagctggcaggacagcctgctgaaaaagtccatcaccgtgccttttccagtggcctacgagacaaacgaggacatgacctggttcaagaacgagcggggcagaatctgcgtgaagttcagcggactgagcgagcacaccttccaggtgtactgcgacagcagacagctgcagtggttccagcggttccttgaggaccagcagatcaagcggaacagcaagaaccagcacagcagcagcctgttcaccctgagatccggaagaatcgcctggcaagaaggcgagggcaagagcgagccctggaaagtgaaccggctgatcctgtactgcagcgtggacacaagactgtggacagccgagggcaccaatctcgtgcgggaagagaaggccgaggaaatcgccaaggctatcgcccagacaaaggccaagggaaagctgaacgacaagcagcaggcccacatcaagagaaagaacagctccctggccagaatcaacaatctgttccccagacctagcaagcccctgtacaagggccagagccatatcctcgtgggagtgtctctgggcctcgagaagcctacaacactggctgtggtggatggcagcatcggcaaggtgctgacctaccggaacatcaaacagctgctgggcgacaactaccggctgctgaacagacagcggcagcagaagcacacactgagccaccagagacaggtggcccagattctggctagccctaatcagctgggcgagtctgagctgggccagtacgttgacagactgctggctaaagaaatcgtggccatcacacagacctacaaggccggctctatcgtgctgcccaagctgggagacatgagagaacaggtgcagtccgagatccaggccaaggccgagcagaagtccgatctgattgaggttcagcagaagtacagcaagcagtaccgggtgtccgtgcaccagtggtcttacggcagactgatcgccagcatcagatccagcgccgccaaagtgggcatcgtgatcgaggaaagcaagcagcccatccggggaagccctcaagaaaaggccagagaactggccattgccgcctacaactccagaaggcggacttga

SEQ ID NO: 1193 - DNA, 480 bp, Trichormus variabilis
ttgacaaaaagcagaaccttgaaaatagaatagatataactaatagcgccgcagttcatgctttgttcaaagcctctgtactgtgtaaatgtgggttagtttgactgttggaaaacagtcttgctttctgaccctggtagctgcccaccttgatgctgctgtcccttgaggacaggaataaggtgcgcccccagtaatagaggtgcgggtttaccgcagtggtggctaccgaatcacctccgatcaaggaggaacccaccttaattatttatttttggcaaaccacaagcgaggtcaattttccagggaggtttgccaaaagtccaaatcccttgtctagtctgcgttttatttattggtatgtttcgatgattcgccttgaagggtgaagtcgagagcagatttagacacctttgccaaaatcacttttggaagtgtctctagataagggtttggtcgggcggagtttcaacacccctc

SEQ ID NO: 1194 - DNA, 37 bp, Trichormus variabilis
gtttcaacacccctcccgaagtggggcgggttgaaag

SEQ ID NO: 1195 - DNA, 532 bp, Trichormus variabilis
  misc_feature (509)..(532): n is a, c, g, or t
ttgacaaaaagcagaaccttgaaaatagaatagatataactaatagcgccgcagttcatgctttgttcaaagcctctgtactgtgtaaatgtgggttagtttgactgttggaaaacagtcttgctttctgaccctggtagctgcccaccttgatgctgctgtcccttgaggacaggaataaggtgcgcccccagtaatagaggtgcgggtttaccgcagtggtggctaccgaatcacctccgatcaaggaggaacccaccttaattatttatttttggcaaaccacaagcgaggtcaattttccagggaggtttgccaaaagtccaaatcccttgtctagtctgcgttttatttattggtatgtttcgatgattcgccttgaagggtgaagtcgagagcagatttagacacctttgccaaaatcacttttggaagtgtctctagataagggtttggtcgggcggagtttcaacacccctcgaaatcccgaagtggggcgggttgaaagnnnnnnnnnnnnnnnnnnnnnnnn

SEQ ID NO: 1196 - DNA, 500 bp, Trichormus variabilis
tatggtaatagtgcaaatgaagataggaagcacctcgccaacttagatccggaaaacggggtgaagcgatcgcctgttggttgacaactgcacttgtagagcgacaaataatttgtcgttctacaattgtcgattgccaaattatatgaccacttgacaagttaatgtcattcaaaatattatcctcaaaacccttgccaagcaagggttttgttattttaggctcaaaatacccagaaacttattgccaaaatagctgtcctcttttgaaaagttgacgaaatatctgtccttgcttgaaaagggacttgagggaagatttttacagaaattgacaaaataaatgtcctccaagtagtacaatacaactacgtttttattgaacatttatgtaaatatgctggatgatcctgataagggcaatcaagagccagaaacgcatgagatagtgactgagctatcactagatgagcagcatttgctggaaatgattcagaaac

SEQ ID NO: 1197 - DNA, 500 bp, Trichormus variabilis
ccgaagtggggcgggttgaaagaccttcatgcaaggatataaaaaattttaggtgggttgaaaggcgcacttcgttcgggattttccctgaccgaaacagtaccaataaatcaaagctattataataacagcttctaatgccaatacaccttgatgactaagtaatttggcaacgcggacaacaacttggcaatacggacaacaatttgtcaacgcagacaaagaatttggcaatcgacaacaataatcgggatgactggattcgaaccagcggccccttcgtcccgaacgaagtgcgctaccaagctgcgctacatcccgttaaaaaatttatacgccttttttagcataacataaataatagtcaatacagaaaagacatctacatctatatatatagatgaatcggaacgggatttgcttgctaggattagatttgtataacattcagtggtaaaagcggattgtgactgtaaaaccagactggttgcgggtaaaag

SEQ ID NO: 1198 - DNA, 1743 bp, Nostoc species
atggacgagatgcccatcgtgaagcaggacgacgagagcctgcctgtggaaaacaacgacgatgtggatgagatccaggacgatgagctggaagagacaaacgtgatcttcaccgagctgagcgccgaggccaagctgaagatggatgtgattcagggcctgctggaaccctgcgacagaaagacatacggcgagaagctgagagtggccgccgagaaactgggaaagacagtgcggacagtgcagcggctggtcaagaagtatcagcaggacggcctgagcgccatcgtggaaacccagagaaacgacaagggcagctaccggatcgaccccgagtggcagaaattcatcgtgaacaccttcaaagagggcaacaagggctccaagaagatgacccctgctcaggtggccatgagagtgcaagttcgggctgaacagctgggcctgcagaaatttcccagccacatgaccgtgtaccgggtgctgaaccccatcatcgagcggcaagagcggaagcagaagcagagaaacatcggctggcggggcagcagagtgtcccacaagacaagagatggccagacactggacgtgcggtacagcaatcacgtgtggcagtgcgaccacaccaagctggatgtcatgctggtggaccagtacggcgagcctcttgccagaccatggttcaccaagatcaccgacagctacagccggtgcatcatgggcatccacgtgggctttgatgcccctagctctcaggttgtggccctggcctctagacacgccattctgcctaagcagtacagcgccgagtacaaactgatcagcgactggggcacctacggcgtgcccgagaatctgtttacagacggcggcagagacttcagaagcgagcacctgaagcagatcggcttccagctgggcttcgagtgtcacctgagagacagacctagcgaaggcggcatcgaggaaagaagcttcggaacaatcaataccgagttcctgagcggcttctacggctacctgggcagcaacatccaagagagaagcaagaccgccgaggaagaggcctgtctgacactgagagagctgcatctgctgctcgtgcgctacatcgtggacaactacaaccagaggctggacgcccggaccaaggaccagaccagatttcagagatgggaggccggactgcctgctctgcccaagatggtcaaagagcgcgagctggacatctgcctgatgaagaaaacccggcggagcatctacaaaggcggctatctgagcttcgagaacatcatgtaccggggcgattacctggccgcctatgccggcgagaatatcgtgctgagatacgaccccagagacatcaccaccgtgtgggtgtacagaatcgataagggcaaagaggtgttcctgtccgccgctcatgccctggattgggagacagaacagctgtccctggaagaagccaaggccgcctctagaaaagtgcggagcgtgggcaagaccctgagcaacaagtctatcctggccgagatccacgaccgggacacctttatcaagcagaagaagaagtcccagaaagagcgcaagaaagaggaacaggcccaggtccacgccgtgtacgagcctatcaatctgagcgagacagagcccctggaaaacctgcaagagacacccaagcctgtgaccagaaagccccggatcttcaactacgagcagctgcggcaggactacgacgagtaa

SEQ ID NO: 1199 - DNA, 840 bp, Nostoc species
atgaaggacgactactggcagagatgggtgcagaacctgtggggcgacgagcccattcctgaagaactgcagcccgagatcgagagactgctgagcccttctgtggtggaactggaacacatccagaagatccacgactggctggacggcctgagactgtctaagcagtgcggcagaattgtggcccctcctagagccggcaagagcgtgacatgtgacgtgtaccggctgctgaacaagccccagaagagaggcggcaagcgggatattgtgcccgtgctgtatatgcaggtccccggcgattgctctagcggagaactgctggtgctgatcctggaaagcctgaagtacgatgccaccagcggcaagctgaccgacctgagaagaagagtgcagcgcctgctgaaagaaagcaaggtggaaatgctgattatcgacgaggccaacttcctcaagctgaacaccttcagcgagatcgcccggatctacgacctgctgagaatcagcatcgtgctcgtgggcaccgacggcctggacaacctgattaagagagagccctacatccacgaccggttcatcgagtgctacaagctgcccctggtggaaagcgagaagaaattcaccgagctggtcaagatctgggaagaagaggtgctctgcctgcctctgcctagcaacctgaccagaagcgagacactggaacccctgcggagaaagaccggcggaaagatcggactggtggacagagtgctgcggagagcctctattctggccctgagaaagggcctgaagaatatcgacaaagaaaccctgaccgaggtgctggattggttcgagtga

SEQ ID NO: 1200 - DNA, 504 bp, Nostoc species
atggaaatcggagccgaggaaccccacatcttcgaggtggaacctctggaaggcgagagcctgtctcacttcctgggcagattcagaagagagaactacctgaccagcagccagctgggcaagctgacaggactgggagctgtggtgtcccggtggaagaagctgtacttcaacccatttccaacgcggcaagagctggaagccctgacctctgtcgtcagagtgaacgccgatagactggccgagatgctgcctcctaagggcgtgaccatgaagcccagacctatcagactgtgcgccgcctgttatgccgaggtgccctgtcacagaatcgagtggcagttcaaggacgtgatgaagtgcgaccggcacaacctgagactgctgaccaagtgcaccaactgcgagacaagcttccccattcctgccgaatgggtgcagggcgagtgccctcactgctttctgccttttgccaccatggccaagcggcagaaacacggctaa

SEQ ID NO: 1201 - DNA, 1908 bp, Nostoc species
atgagcgtgatcaccatccagtgcagactggtggccgaagaggacatcctgagacagctgtgggagctgatggccgacaagaacacccctctgatcaacgagctgctggcccaagtgggaaagcaccccgagtttgagacatggctggacaagggcagaatccccaccaagctgctgaaaaccctggtcaacagcttcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgtagcctgagcgccatcaggaccaaggccaacgagatcctgacacagttcacccctcagagcgagcagaacaagaaccagcggaagggcaaaaagaccaagaagtccaccaagtccgagaagtccagcctgttccagatcctgctgaacacctacgagcagacccagaatcctctgaccagatgcgccattgcctacctgctgaagaacaactgccagatcagcgagctggacgaggacagcgaggaattcaccaagaaccgccggaagaaagagattgagatcgagcgcctgaagaatcagctgcagagcaggatccctaagggcagagatctgaccggcgaggaatggctcaagaccctggaaatcagcaccgccaacgtgccccagaacgagaatgaagccaaggcctggcaagccgctctgctgagaaaaagcgccgacgtgccatttcctgtggcctacgagagcaacgaggacatgacctggctgcagaacgacaaaggcagactgttcgtgcggttcaacggcctgggcaagctgaccttcgagatctactgcgacaagcggcatctgcactacttcaagcggtttctcgaggaccaagagctgaagcggaaccacaagaatcagtacagcagctccctgttcaccctgcggagtggtagacttgcttggagccctggcgaggaaaaaggcgagccctggaaagtgaaccagctgcacctgtactgcaccctggacaccagaatgtggaccatcgagggaacccagcaggtcgtggacgagaaaagcaccaagatcaacgaaaccctgacaaaggccaagcagaaggacgacctgaacgaccagcagcaggccttcatcaccagacagcagagcacactggaccggatcaacaatctgttccccagacctagcaagagcagataccagggccagccttctatcctcgtgggcgtgtccttcggcctgaaaaagcctgtgacagtggccgtggtggacgtggtcaagaatgaggtgctggcctacagaagcgtgaaacagctgctgggcgagaactacaatctgctgaaccggcagcgacagcagcagcagagactgtctcacgagagacacaaggcccagaagcagaacgcccctaacagctttggcgagtctgagctgggccagtacatcgacagactgctggctgacgccatcattgccattgccaagacataccaggccggctccatcgtgctgcccaagctgagagatatgagagagcagatcagcagcgagatccagagcagagccgagaagaagtgccccggctacaaagaggtgcagcagaagtacgccaaagaataccggatgagcgtgcaccggtggtcctacggcagactgatcgagtgcatcaagagccaggccgccaaggccggaatctctacagagatcggcacccagcctatccggggctctcctcaagagaaggccagagatgtggccgtgttcgcctaccaagaaagacaggccgctctgatctga

SEQ ID NO: 1202 - DNA, 496 bp, Nostoc species
ttcactaatccgaaccttgaaaatataatatttttataacagcgccgcagttcatgcttttttaagccaatgtactgtgaaaaatctgggttagtttggcggttggaaggccgtcatgctttctgacccttgtagctgcccgcttctgatgctgccatctttagaattctataggtgggataggtgcgctcccagcaataaggagtaaggcttttagctatagccgttattcataacggtgcggattaccacagtggtggctactgaatcacccccttcgtcgggggaaccctcccaaatatttttttggcgtgtcaaagtgggggcaaaatccccggagtcccgccaaaactttaaaacccttatccagtcttgaattaagaaactagtatgtaaatcaatttagtattttaattttcagatcgagactattttaagctgacctgccaaagtatgtgtatggaaagctttgatagcaagggttctagacgggtcg

SEQ ID NO: 1203 - DNA, 37 bp, Nostoc species
gtttcaacaaccatcccggctagaggtgggttgaaag

SEQ ID NO: 1204 - DNA, 548 bp, Nostoc species
  misc_feature (525)..(548): n is a, c, g, or t
ttcactaatccgaaccttgaaaatataatatttttataacagcgccgcagttcatgcttttttaagccaatgtactgtgaaaaatctgggttagtttggcggttggaaggccgtcatgctttctgacccttgtagctgcccgcttctgatgctgccatctttagaattctataggtgggataggtgcgctcccagcaataaggagtaaggcttttagctatagccgttattcataacggtgcggattaccacagtggtggctactgaatcacccccttcgtcgggggaaccctcccaaatatttttttggcgtgtcaaagtgggggcaaaatccccggagtcccgccaaaactttaaaacccttatccagtcttgaattaagaaactagtatgtaaatcaatttagtattttaattttcagatcgagactattttaagctgacctgccaaagtatgtgtatggaaagctttgatagcaagggttctagacgggtcggaaatcccggctagaggtgggttgaaagnnnnnnnnnnnnnnnnnnnnnnnn

SEQ ID NO: 1205 - DNA, 500 bp, Nostoc species
agcaaatattgctatcatatttttttagtttagttatacttccatgagatattcaacaagtatcaacctcaattaaatgcagataaatttaagttgttgaataactaattatttgtcgtcttaacaaaataatgtcgtcaaatataaaactatcaaaaatgttgctacatgagtgtttacaacgttttttattatgtaatgggttagtagtttatttaacactttacttgtcgttgatttaaataataacaaaataaacgtcgtcttttaaaattttacgttttctaaaattttctagtttcataacaaattagctgtcgctttttagcttgaatagtggtattataattttatttagtacatttgcactaaataatacatccttataccgaaaagttgccgcgtccattgaggggtcaactgctttaggaagtttggatgttctcgcacaatagcgagattgtgattactgttttgagtatgaatcaagttttcctatg

SEQ ID NO: 1206 - DNA, 500 bp, Nostoc species
agtttcaacaactatcccagctagggatgagttgaaagagcgtcagaaaatatttaacagagggttgaaaggtgcatccgacttgtaagcatatttatgaatattatcagggaagtcatcaaataaagatttagctatatttcctgtacaatagatgtctgcaaacactttatcaaattggttagacgacattaatttgttaacgtttcgcaattagcattatacgacactaatttgttaacagtgacattaatttgttaatagcgacagcaatctgttaacaacgacaaataattagttattcgacataagttaaagccagcagctggatttgaacctgcgaccttccgattacaagtcggatgcactaccactgtgctatgctggcattattaagctcaccgatttatgattataacataagcaaaatatttgtctagaggaagctgcgaaaaaaatttgcttggatgttcgagactggaaggttagtacttcaacct

SEQ ID NO: 1207 - DNA, 1707 bp, Chlorogloea species
atgcaggacgacagatccctggaagtgcccattcctgccgaagtgaacgagatcgtgaccgacttcagcgacgacgccaagctgatgcaagaagtgatccagagcctgctggaaccctgcgacagaatcacctacggccagagacagagagaggccgctgccaagctgggaaagtctgtgcggaccatcagacggctggtcaagaagtgggaagccgagggactgaatgccctgcaggccacacagagaaccgacaagggcaagcaccggatcgaccagaagtggcaagagttcatcatcaagacctacaaagagggcaacaagggcagcaagcggatcacccctcagcaggttgcagttagagtggccgccaaagccgccgagctgggccaagagaagtaccccagctaccggaccgtgtacagagtgctgcagcccatcatcgagaagcaggacaagacacagagcgtgcggagcagaggctggcgaggatctagactgagcgtgaaaaccagagatggccaggacctgagcgtggaatactccaaccacgtgtggcagtgcgaccacaccagagctgatgtgctgctggtggacagagatggacagctgcttggcagaccttggctgaccaccgtgatcgacacctacagcagatgcatcatcggcatcaacctgggctacgacgcccctagttctcaggttgtggctctggccctgagacacgccattctgcctaagcagtacagcagcgagtacaagctgcactgcgagtggggcacatacggcaagcctgagcacttctacaccgacggcggcaaggacttcagaagcaaccatctgcagcagatcggcgtgcagctgggcttcgtgtgtcacctgagagacagacctagcgaaggcggcatcgtggaaagacccttcggcaccttcaacaccaacctgttcagcaccctgcctggctacaccggcagcaatgtgcaagagaggcctgaagaggccgagaaagaggccagcctgacactgagagagctggaacaactgctcgtgcggtacatcgtggacaagtacaaccagagcatcgacgcccggatgggcgatcagaccagatttcagagatgggaggccggactgatcgccgtgccttctccaatcagcgagagagatctggacatctgcctgatgaagcagaccagacggaccatctacagaggcggctacctgcagttcgagaacctgacctacaggggcgacagactggaagtgtatgccggcgagtctgtggtgctgagatacgaggaaaaggacatcaccaccatcctggtgtaccggaaagaaggcgggaaagaagtctttctggcccacgcctacgcacaggatctgcagacagagcagctgagctttgacgaggccaaggccagcagccggaagcttagagatgccggaaaggccgtgtccaacagatccatcctggctgaagtgcggtactccgcttctgctctggctgagctgagagagacattcctggctcagaagaagtccaagaaagagcggcagaaaagcgaacaggtgcagatccaccggaagaaagaactgttccccatcgaggccgaagccaccgagtttgagtctctggtggatgagctggaaaccgagacaatcgaggtgttcgactacgagcagatgagggaagattacggcctgtga

SEQ ID NO: 1208 - DNA, 861 bp, Chlorogloea species
atgaatcaagagaaagaggccaaggctatcgcccagcagctgggaaacatccctctgaacgacgagaagatccaggtggaaatccagcggctgaaccggaagaacttcgtgcccctggaacaagtgaaggccctgcacgattggctggaaagcaagagacaggcccggcagtgctgtagagtgatcggcgaaagcagaaccggcaagaccatggcctgcaacgcctacagactgcggcacaagcctatccagcaactgggccagcctcctatcgtgcccgtggtgtacatccagattcctcaagagtgcagccccaaagaactgttcagcgtggtcatcgagcacctgaagtaccaagtgaccaagggcaccaccgccgagatcagaaacagaaccctgcgggtgctgaaaggctgcggcgtggaaatgctgatcatcgacgaggccgaccggctgaagcctaagacctttgctgacgtgcgggacatcttcgacaacctggaaatctccgtggtgctcgtgggcaccgacagactggacaaagtgatgaccaacgacgagcaagtgtgcaacagattcagcgccagctacagatacggcaagatcagcggcgaggaattcaagcggaccgtgaacatctgggagaaccaggtgctgaagctgcccgtgctgagcaatctgacccagcctaagatgctggaaatcctgagaaacaagacccagggctacatcggcctgatggacatgatcctgagggacgccgctatcagagccctgaagaaaggcatgcccaagatcgacctggacaccctgaaagaagtgacgaacgagtacacagcccctccaaagacacagaagtga

SEQ ID NO: 1209 - DNA, 522 bp, Chlorogloea species
atgaagaccagcgacttccagccttggctgttctgcgtggaacctttcgagggcgagagcatcagccactttctgggcagattcagacgggccaacgagatgacccctaacggactggctaaagccgctggactggaaggcgccattgccagatgggagaagttccggttcaaccctccacctagccggcagcaactggaagctctggctgtgcttgttggcctggaagccgatagactggtgcagatgctgcctcctgttggcgtgggcatgaagatggaacccatcagactgtgcggcgcctgctatgcccagtctccttgtcacaagatcgagtggcagttcaagagcacccagggctgtgtgggcgatagccacagacacaagctgagcctgctgagcgagtgccctaattgcggcgccagattcaagatccccgctctgtgggttgacggctggtgccacagatgctttctgcccttcgaggaaatgaccaagcaccagaaactgatccaggtgtag

SEQ ID NO: 1210 - DNA, 1851 bp, Chlorogloea species
atgagccagatcaccatccagtgccggctgatcaccagcgagagcacaagacaccacctgtggaagctgatggccgacctgaacacccctctgatcaacgagctgctgacccagatggcccagcatcctgagtttgagacatggcggaagaagggcaagctgcctggcggcacagtgaaccagctgtgccagcctctgaaaaccgacagccggttcaacaaccagcctggccggttttacaagagcgccatcaccgtggtcgagtacatctacaagtcctggttcaagatccagcagcggctggaacagaagctgaagggccagaccagatggctggaaatgctgaagtccgacgaggaactgaccaccgagtctaacgccagcctggaaaccatctgcaccaacgctgctcagctgctgtctgctctgtctcctgaggaaggcagcatcagcaagagactgtgacaggcctacaacgacaccgacgacctgctgacaagatgcgtgatctgctacctgctgaagaacggcagcaagatccccaagaagctggaagagaacctggaaaagttcggcctgcacagacggcaggccgagatcaagatcgagcggatcaaagagcagctggaaagcagaatccccaacggcagggacctgaccagaaagaactggctggacaccctggaactggccagcacaacagcccctacagatgagagcgaggccaagtcttggaaggacgccctgagcacagagagcaagctgctgccttttccagtggcctacgagacaaacgaggacctgacatggtccaagaacgagaaggaccggctgtgcgtgcagttcaacggcctgagcaagcacatcttccagatctactgcgaccagcgccagctggaatggttcaagcggttctacgaggaccaagagattaagaaggcctctaagaacgagtacagctccggcctgttcaccctgagatctggcagaatcgcctggcaagagggcacagagaaaggcgagctgtggaacatccaccacctgatcctgtactgcgccgtggacaccagactgtggacagccgagggaacagagcaagtgcggcaagagaaggccgaggatatcgccaagacactgaccaacatgaacaagaagggcgacatcaacgacaagcagcaggccttcatccggcggaagcagtctacactggccagactggacaacccatttcctcggccaagcaagcccttctaccagggccagcctcacatccttgtgggagttgccctgggccttgataagcctgctacagtggccgtggttgatggcctggcctccaaagagatcacctaccgctctgtgaaacagctgctgggcgacaactacgaactgctgaacaagcagcggcagctgaagcagagacagtcccaccagagacacaaagcccagagcggcggcagattcaaccagttcagagatagccagctgggcgagtacgtggacagactgctggccaaggccattatcgccttcgctcagacataccacgccggctctatcgtgctgcccaagctgggagacatgagagaactggtgcagagcgaggtgcaggccagagccgagcagaagatccctggatatctggaaggccagaagaagtacgccaagcagtaccgggtgtccatccaccagtggtcttacggcagactgatcgacaacatcaaggcacaggccgccaagctgaacctggtggtggaagagtgtcagcagagcatcagaggcagccctcaagagaaagccaaagaaatggccatctccgcctaccgggaccgcagcatctctaagacatga

SEQ ID NO: 1211 - DNA, 405 bp, Chlorogloea species
tcttaattctgcaccttgacaataaaatagagttatcaatcgcgccgtaagtcatgttcatttgaacctctgaattgcgaaaaatctgggttagtttaactgtctgccgacagttgtgctttctgaagaaaggtagctgctcaccctgatgctgctgtcttcggacaggataggtgcgctcccagcaataagcggcatgggtctactactgtagtggctaccgaatcacctccgagcaaggaggaaccctccttaattattcatttgaaggactaaaaataaggcaaaatttctaagatatccgcgcaagtcctaaattgcttgctctgtctaaatctcatcatttctaacccagacatgatttttgtggtgatagtttgaaggatgggttaattccaatcccat

SEQ ID NO: 1212 - DNA, 37 bp, Chlorogloea species
gtgacaacaaccctcctattacagggtgggttgaaag

SEQ ID NO: 1213 - DNA, 457 bp, Chlorogloea species
  misc_feature (434)..(457): n is a, c, g, or t
tcttaattctgcaccttgacaataaaatagagttatcaatcgcgccgtaagtcatgttcatttgaacctctgaattgcgaaaaatctgggttagtttaactgtctgccgacagttgtgctttctgaagaaaggtagctgctcaccctgatgctgctgtcttcggacaggataggtgcgctcccagcaataagcggcatgggtctactactgtagtggctaccgaatcacctccgagcaaggaggaaccctccttaattattcatttgaaggactaaaaataaggcaaaatttctaagatatccgcgcaagtcctaaattgcttgctctgtctaaatctcatcatttctaacccagacatgatttttgtggtgatagtttgaaggatgggttaattccaatcccatgaaatcctattacagggtgggttgaaagnnnnnnnnnnnnnnnnnnnnnnnn

SEQ ID NO: 1214 - DNA, 500 bp, Chlorogloea species
ttgcctccaatcgtcagcaacgctcacatccataaagttgctaattttccatcaactcagcttacgacaccgagaatttgcagaggtactaatttgtcgattgccacattatttgtccacttgccaaattattgaccgctaattctaatagcttgctagcctaatctacacaagggttacagctattaaatctcctaaaaatattgaataagctttttgacaaattagttgtccggtttatgaaacttgacaaattctttgtcctctcttgaaagaggcgaaaatcacaacttttgtaaagaattgacacaatctttgtccttaaaaggataatacaaacatgattgtataaaacaattgtgtaaatatgcaggatgatcgctccttggaagtaccaatacctgctgaagtaaatgaaatcgtcactgatttctctgatgatgcaaagctgatgcaggaagtgatccagagtcttttggaaccctgtgatcgcattacct

SEQ ID NO: 1215 - DNA, 600 bp, Chlorogloea species
gtgacaacaaccctcctattacagggtgggttggaagtgattactgtctcgatgtgctgggcgcgatcgcccaatagtttcaacacccctcccagctagaggcgagttgaaagtagtcgtggtacgagaagtggaagaaaaggatcgggctgtttcaactttccttccagctagggcgggttgaaagtcaatccctatattgttggcggtttaagcgcgatcagtgtttcaactccactcctaacaggaggcaggttgaaagatatgacaaagtttgcaaaagcaaaagcttttgaagaaaaaggtgggttgaaaggcgcacttcgttcgggattgttccgacttagtaattacaaagttaatagggtggagttatcatagaaactcacagaaattctgcccggttgattaaaggaagaaccgacctatcaagcggacactaatttgtcaaagcgacatcaatttgacaacgacgacaaataattagtcaatcgacaaattttgtacattcgcacattatatgtcgcaattctcaagccaggtcgtaactgcttttaaagcctgagaactcaatcgtgtaaccatcgtagtctatttacc

SEQ ID NO: 1216 - DNA, 1890 bp, Anabaena species
atgagcggctttcacagcatggccgacagagagatcgagttcaccgaggaaagcacccaggacagcgacgccatcctgctggacaacagcaacttcgtggtggaccccagccagatcatcctggccacaagcgacaagcacaagctgaccttcaacctgatccagtggctggctcagagccccaccagaaccgtgaagtccgagagaaagcaggccattgccaacacactgagcgtgtccaccagacaggtggaacggctgctgaagcagtacaacgaggacaagctgagagagacagccggcaccgagagagccgataagggcaagcacagagtgtccgagtactggcaagagttcatcaagaccacctacgagaagtccctgaaggacaagcaccctatcagccccgcctctatcgtgcgggaagtgaagagacacgccatcgtggacctgggactgaagcctggcgattatccacaccaggccaccgtgtaccggatcctggaacctctgattgcccagcacaagagaaagaccagagtgcggaatcctggcagcggcagctggatgacagtggtcacaagagatggccagctgctgagagccgacttcagcaaccagatcattcagtgcgaccacaccaagctggacatccggatcgtggacatccacggcgatctgctgagcgaaagaccttggctgaccaccgtggtggatacctacagctcttgcgtgctgggcttcagactgtggatcaagcagcctggcagcaccgaagttgccctggctctgagacatgccattctgcccaagcagtaccccgacgactaccagctgaacaagagctggaacgtgtacggcaaccccttccagtacttcttcaccgacggcggcaaggacttcagaagcaagcacctgaaggccatcggcaagaaactgggcttccagtgcgagctgagggacagacctcctgaaggcggcatcgtggaacggatcttcaagaccatcaacacccaggtgctgaaggacctgcctggctacacaggcgccaatgtgcaagagaggcctgagaacgccgagaaagaggcctgtctgaccatccaggacctggacaagatcctggcctccttcttctgcgacatctacaaccacgagccgtatcctaaagagccccgggacaccagattcgagcggtggtttaaaggcatgggcgagaagctgcccgagcggctggatgagagagagctggatatctgcctgatgaaagaaacccagagagtggtgcaggcccacggcagcatccagttcgagaacctgatctacagaggcgagtctctgaaggcccacaagggcgagtacgtgaccctgagatacgaccccgaccacatcctgacactgttcgtgtacagctgcgagacagacgacaacctggaagagttcctgggctatgcccacgccgtgaacatggacacacacgacctgagcctggaagaactgaaaaccctgaacaaagagcggagcaaggcccggaaagagcacttcaattacgacgccctgctggccctgggcaagagaaaagaactggtggacgagcggaaggccgacaagaaagagaagaggcacagcgagcagaagcggctgagaagcgccagcaagaaggacagcaacatcatcgagctgcggaagtcccgggtgtccaagagcctgagaaagcaagagactcaagagatcctgcctgagagagtgtccagggaagagatcaagtttgagaagatcgaactcgagccccaagaaaccctgagcgctagccccaagcctaatcctcaagaggaacagagacacaagctggtgctgagcaagaggcagaagaacctgaagaacatctggtga

SEQ ID NO: 1217 - DNA, 855 bp, Anabaena species
atggccagatctcagctggccaaccagcctatcgtggaagtgctggctcctcagctggacctgaatgcccagatcgccaaggccatcgacatcgaggaaatcttccggaactgcttcatcaccaccgaccgggtgtccgagtgcttcagatggctggacgagctgcggatcctgaagcagtgcggcagaatcatcggccccagaaacgtgggcaagagcagagctgccctgcactacagagatgaggacaagaaacggatcagctacgtgaaggcttggagcgccagcagcagcaagagaatcttcagccagattctgaaggacatcaaccacgccgctcctaccggcaagagacaggatctcagacctagactggccggcagcctggaactgttcggactggaactggtcatcatcgacaacgccgacaacctgcagaaagaggccctgatcgacctcaagcagctgttcgaggaatgccacgtgccaatcgtgctgatcggcggcaaagagctggacaacattctgcaggactgcgacctgctgaccaactttcccacactgtacgagttcgagcggctggaatacgacgacttcagaaagaccctgagcaccatcgagctggatatcctgagcctgcctgagtctagccatctggccgagggcaacatcttcgagatcctggccgtgtctaccagcggcaggatgggcatcctggtcaagatcctgacaaaggccgtgctgcacagcctgaagaacggcttcggaagagtggacgagagcatcctggaaaagatcgccagcagatacggcaccaaatacgtgcccctggaaaaccggaaccggaacgagtaa

SEQ ID NO: 1218 - DNA, 555 bp, Anabaena species
atggtgcagaatatgttcctgagcaagaccgagacaggcatgaacgaggacgacgagatcagacccaagctgggctacgtggaaccttacgagggcgagagcatcagccactacctgggcagactgcggagattcaaggccaacagcctgcctagcggctacagcctgggaaagattgctggactgggcgccgtgaccaccagatgggagaagctgtacttcaacccatttcctaaccggcaagagctggaagccctggcctctgttgtgggagtgtctgccgagcggttcatcgagatgctgcctccaaagggcgtgaccatgaagcccagacctatcagactgtgcgccgcctgttatgccgaggtgccctgtcacagaatcgactggcagttcaaggacaagatgaagtgcgaccggcacaacctgcggctgctgaccaagtgcaccaactgcgagacaccctttcctatacctgccgattgggcccagggcgagtgtcctcactgtagcctgagcttcgccaagatggtcaagcggcagaaactgcggtga

SEQ ID NO: 1219 - DNA, 1899 bp, Anabaena species
atgagcgtgatcaccatccagtgcagactggtggccgaagaggacaccctgagaacactgtgggagctgatggccgacaagaacacccctctgatcaacgagattctggcccaagtgggcaagcaccccgagttcgaaacctggctggaaaagggcaagatccccaccgagctgctgaaaaccctggtcaacagcctgaaaacgcaagagagattcgccagccagcctggcagattctacacctctgccattgctctggtggactacgtgtacaagagttggttcgccctgcagaagcggcggaagagacagatcgagggcaaagagagatggctgaccatcctgaagtccgacctggaactggaacaagagtcccagtgcagcctgaacatcatccggaccaaggccaccgagatcatcaccgagtttacccctcagagcgaccagaacaacagccagaagaagcggaagaaaaccaccaagagcaccaagcctagcctgttccagatcctgctgaacaactacgaggaaacccaggacatcctgaccagatgcgccctggcctacctgctgaagaacaattgccagatcagcgagcgggacgagaaccccgaggaattcaccagaaaccgccggaagaaagagattgagatcgagcggctgaaggaccagctgcagagcagaatccccaagggcagagatctgaccggcgaggaatggctcaagaccctggaagttgtgcgggccaacgtgacccagaacgagaatgaagccaaggcctggcaggccgccatcctgagaaaatctgccgacgtgccatttcctgtggcctacgagagcaacgaggacatgacctggctgcagaacgataagggcagactgttcgtgcggttcaacggcctgggcaagctgaccttcgagatctactgcgacaagcggcatctgcactacttcaagcgctttctcgaggaccaagagctgaagcggaacagcaagaaccagtacagcagcagcctgtttaccctgcggagtggcagacttgcttggagccctggcgaggaaaaaggcgagccctggaaagtgaatcagctgcacctgtactgcaccctggacaccagaatgtggaccatcgagggaacccagcaggtcgtggatgagaagtccaccaagatcacagagacactgacaaaggccaagcagaaggacgacctgaacgacaagcagcaggccttcgtgaccagacagcagagcaccctgaaccggatcaacaatctgttccccagacctagcaagagcagataccagggccagccttctatcctcgtgggcgtgtccttcggcctggaaaatcctgtgacactggccgtggtggacgtggtcaagaatgaggtgctggcctacagaagcgtgaaacagctgctgggcaagaactacaatctgctgaaccggcagcggcagcagcaacagagactgagccacaagagacacaaggcccagaagagaaacgcccctaacagcttcggcgagtctgagctgggccagtacgttgacagactgctggctgacgccatcattgccattgccaagacataccaggccggcagcatcgtgatccccaagctgagagacatgagagagcagatcagctccgagatccagagcagagccgagaagaagttccccggctacaaagaggcccagcagaaatacgccaaagaataccggatgagcgtgcaccggtggtcctacggcagactgatcgagagcatcaagagccaggccgctaaggccggcatctctacagagatcggcacccagcctatccggggctctcctcaagagaaggctagagatctggccgtgttcgcctaccaagagagacaggctgccctgatctga

SEQ ID NO: 1220 - DNA, 495 bp, Anabaena species
ttcactaatccgaaccttgaaaatataatattgttatgatcgcgccgcagttcatgctcttttgagccaatgtactgtgaaaaatctgggttagtttggcggttggaagaccgtcatgctttctgaccctggtagctgcccgcttctgatgctgccgtctgtagaattctatagatgggataggtgcgctcccagcaataaggagtaaggcttttagctgtagccgttattcataacggtgtggattaccacagtggtggctactgaatcacccccttcgtcgggggaatcctcccaaatatttttttggcaaatcgaagcggggtcaaaaaccctggggacttgccaaactctgaaaacccttgtcctgtattgaatcaagaaattagtgcgtcaattgatttacttttttcattgtcggcagaagcagctttttaacagacttgtcaaatagacatctgaaaagcttatataacaagggtctaggcgggaaca

SEQ ID NO: 1221 - DNA, 37 bp, Anabaena species
gtttcaacgaccatcccggctaggggtgggttgaaag

SEQ ID NO: 1222 - DNA, 547 bp, Anabaena species
  misc_feature (524)..(547): n is a, c, g, or t
ttcactaatccgaaccttgaaaatataatattgttatgatcgcgccgcagttcatgctcttttgagccaatgtactgtgaaaaatctgggttagtttggcggttggaagaccgtcatgctttctgaccctggtagctgcccgcttctgatgctgccgtctgtagaattctatagatgggataggtgcgctcccagcaataaggagtaaggcttttagctgtagccgttattcataacggtgtggattaccacagtggtggctactgaatcacccccttcgtcgggggaatcctcccaaatatttttttggcaaatcgaagcggggtcaaaaaccctggggacttgccaaactctgaaaacccttgtcctgtattgaatcaagaaattagtgcgtcaattgatttacttttttcattgtcggcagaagcagctttttaacagacttgtcaaatagacatctgaaaagcttatataacaagggtctaggcgggaacagaaatcccggctaggggtgggttgaaagnnnnnnnnnnnnnnnnnnnnnnnn

SEQ ID NO: 1223 - DNA, 600 bp, Anabaena species
tttattttcttgtatttataagcacataagtaaaaataagtattctatgtatacctagtgatataagaatacacatatttaacaagatatatgaataaaattttgataaattttctgtaaaaacagtgaatatacttaatttttaattaaattttccaaattcaggactttcaagatattgacatttctgtggttagtattataccgtcccaatattcagattccaaaacattagtttctcttccattcgcaaattgaggaagcacagacggcacaaaccgataattatcagagtcaaaaatcgacaaaaggatgattgaaaagtgtacattcgcaaattaaatgtcgcttttcgcaaacaatgtcgcaactgtattgaatggctgaaagctacatcgtgtaaatattataggtcatttatctctaagacaggctaatttgcttgtttcgcatattatatgtcgcataatcacgtttttgcaaattaaatgtcgtttgttaaagttggtgacttttgcaaattaaatgtcgtattctttatgaatatatggtacattagtaccttaattactcatgagtgggtttcactctatggcagac

SEQ ID NO: 1224 - DNA, 900 bp, Anabaena species
agtttcaacgaccatcccggctaggggtgggttgaaagacttagataatcaatcctagaaaaaacgctcttagtttatccgtctttgcgctacaaaaatcttgtcaaatggggtagggttgaaaggtgcatccgacttgtaagcgtattaaaccttaaaaacataaaacaaaaaattaaaacttatttaattctgattttttatatgtaagaattaggttctgcacaaccatcaattcacttgttgaagtaatattattgtgttaacacttgcttgtaagcaacactgtaacaatctagaaggaaaaaacgacattaatgtgcgaaaacctagcataactaaattgattataaaaaatagccgaagcgacatcaatttgagaaaaccgacactaaattgcgaaaagcgacatttaatttgcgaatgtacagattgaaaagccagcagtcggatttgaaccgacgaccttccgattacaagtcggatgcactaccactgtgctatgctggcaaattaggtgatgcgtttgaatcattcaccgatttctaattatagcacaacaaaattatttgtctagtcctgatttgatttttctctagggttgatggttgactggagtttcttctccctccacttcccccacttcccccactccccagcgttgccaagatgtagaaattctcaaaaatcagtgatggcaaaacctcacaaacttgataaattaataggcatagcaaaatcagctagagcctagacttgaagaaaaaacattgagtacagttgccaaactgtatttttttttgactagcagtatagaattgttctttacagattcaaaagcatggcaacattgtttggacgcgatttgttaagtctggcggacttgaatcctacagaact

SEQ ID NO: 1225 - DNA, 1668 bp, Spirulina major
atgaacaccggcaatcaagaggcccacgccgtgatcaccgacttcagcgaggaagaacggctgaagctggaagtgatccagagcctgatggaaccctgcgaccacgccacatatggccagaagctgaaagacgccgctcagaagctgggcaagagcaagagaaccgtgcagagactggtgcagcagtgggaagaaatgggactcgccgccgtgacatctaaggccagagccgataagggcaagcaccggatctctcaagagtggcaggacttcatcgtgaaaacctaccggctgggcaacaagggcagcaagcggatgagcagaaaacaggtggccctgagagtgcaggctagagccgctgagctgggcgagaagatgtaccccaacgagcggaccgtgtacagagtgctgcagcctatcatcgaggcccaagaacagaaaaagagcgtgcggagcgctggctggcggggagatagactgagcgtgaaaacacggaccggcaacgacctggtggtcgagtacaccaatcaagtgtggcagtgcgaccacacctgggtcgacgtgctggtggttgacgtggaaggcaacatcatcggcagaccctggctgaccaccgtgatcgacacctacagcagatgcatcctgggcatcagactgggcttcgatgcccctagttctcaggtggtggctctggctctgagacacgccatgctgcctaagcagtaccctcctacattcggcctgcagtgcgagtggggcacatacggcaagcccgagtacttctacaccgacggcggcaaggacttcagaagcgagcacctgagacagatcggcatccagctggggtttacctgcgagctgagagacagaccttctgaaggcggagccgtggaaagacctttcggcaccctgaacaccgagctgttctctaccctgcctggctacaccggcagcaacatccaagaaagacccgaggacgccgagaaggacgccagaatgacactgagagatctggaacagctgatcgtgcgctacctggtggacaactacaaccagcggctggacaagagaatgggcgaccagaccagataccagagatgggagtctggcctgctggccacaccagctctgctgtctgagagagagctggacatctgcctgatgaagcagaccaaccggtccatctacagagagggctacatcagattcgagaacctcatgtacaagggcgagtacctggccggctatgtgggcgaaagagtggtgctgagatacgaccccagagacatcaccacagtgctggtgtaccggcgcgagaagtcccaagaagtgttcctggccagagcttacgcccaggacctggaaacagagcagctgaccctggaagatgccaaggccatcaacaagaagatccgcgagaagggcaagaccatcagcaaccgcagcatcctggacgaagtgcgggacagagatctgttcgtgtccaagaaaaagacgaagaaagagcgccagaaagaggaacagacccggctgttcacccctgtgacaacccctaacagcaagcaagaaaccgaggaagaggaaatcgagcccgtcgagaagatcgacgagctgccccaggtggaaatcctggactacgatgagctgaacgacgactacggctggtga

SEQ ID NO: 1226 - DNA, 855 bp, Spirulina major
atgatggccagcgccgagtctaaggccaaagctgaagctgtggctcagcagctgggcaacttcgagaaaaccgaagaggacctggccaaagagatccagcggctgcggagaagaaacgtggtgcagctggaacaagtgaagcagctgcacaactggctggaaggcaagcggagaagcagacagtgctgtagagtcgtgggcgagagcagaaccggcaagaccatcggctgcaacgcctacagactgcggcacaagcccatccaagagacaggcaagcctcctatcgtgcccgtggtgtacattgagcctccacaggattgcggcagcatcgacctgttcagagccatcatcgagtacctgaagtacaaggtgcagagccgcgagaaagtgcgcgagctgagatccagagccatgaaggtgctggaacggtgccaggtggaaaccctgatcatcgacgaggccgacagactgaagcccaagacctttgccgacgtgcgggacatcttcgacaagcggaatatcagcgtggtgctcgtgggcaccgacaggctggacaatgtgatcaagcgggacgaacaggtgcacaacagattccgggcctgctacagattcggcaagctgaccggcaccgagttcgagcaggttgtgaagatctgggagagagacatcctgcggctgcccattcctagcaacctgcacgccaagaacatgctgaagatcctcggacaggccaccggcggctatatcggactgctggatatgatcctgcgggaaaccgccgtcagagccctggaaaaaggcctgggcaagatcaacctggaaacactgaaagaggtggccgaagagtacagctga

SEQ ID NO: 1227 - DNA, 504 bp, Spirulina major
atgaacgactgggagatccagccttggctgttcgtggtggaaccttacgagggcgagagcctgtctcacttcctgggcagattcagaagagagaacgatctgacccctgccggcctgggaagagaggctgaaattggagccgtggtgtccagatgggagaagttccggctgatcccatttcctagccagagagagctggaaaagctggcccaggtggtgcaagtggatgccgctagactgagagtgatgctgcctcctgatggcgtgggcatgaagatgacccctatcagactgtgcggcgcctgctacagagaagtgcggtgccacagaatggaatggcagtacaagaccagcgaccgctgcgacaagcaccctctgagactgctgagcgagtgccctaattgcggcgccagatttcccattccaagcctgtggcaggatggctggtgcacccggtgctttaccacctttggagagatggccgagagccagaaacctctgtga

SEQ ID NO: 1228 - DNA, 1893 bp, Spirulina major
atggtggtcatgagccagatcaccatccagtgcagactggtggccagcgaggctacaagacaggtgctgtggacactgatggccgagagaaacacccctctgatcaacgagctgctggcccagatggcccagcatcctgatcttgaagagtggcggcagaagggcaagcctacacctggcgttgtgaagaagctgtgcgaccctctgagacaggaccccagattcatgggccagcctggcagattctacagcagcgctattgccctggtcgagtacatctacaagagctggctgaagctgcagcagagactgcagagaaagctggaaggccagcagagatggctgggcatgctgaagtctgaccccgagctgtgtgaagagaaccactgcaccctggacaccctgagagataaggccgccgagattctggcctctctggaaagccctcagcctaagcagggcaaagtcaagaccaagaaggccaaggctcagagcagccccagacagagcctgttcgaaatgcatgacggcgccgaggacggcttcgtgaaaagcgccattgcctacctgctgaagaacggcggcaagctgcctacacacgaagaggaccctaagaagttcgccaagcggcggagaaaggccgaagtgaaggtggaaagactgatccaccagattaccgccagcctgcctaagggcagagatctgacaggcgaacggtggctggaaaccctgctgacagccagctatacagcccctaaggatgcccagcagaccaaagtgtggcagagcatcctgctgaccaagacaaaggccgtgccttatcctatcaactacgagacaaacgaggacctgacctggtccaagaacgagaagggcagactgtgcgtgcggttcaatggcctgagcgagcacaccttccagatctactgcgaccagagacagctgaagtggttccagcggttctacgaggatcaagaagtgaagcggaccagcaagaaccagcacagcaccagcctgtttaccctgcggagcggaagaatcgtgtggcaagagagcgaccggaacgacaagccttggaccgccaatcacatcaccctgtgctgtaccctggataccagactttggagcgccgagggcacagaggaagtgcggacagaaaaggccatcgatatcgccaagacactgaccaacatgaatgagaagggcgacctcaacgataagcagcaggccttcatcaagagaaagaccgccacactggaccggatcaacaacccctatcctcggcctagcaagcccctgtatcacggccagtctcacatcctcgtgggagttgccctgggccttgataagcctgctacagtggctgtggtggatggcacaacaggcaaggccatcacctaccggaacctgaaacagctgctgggcgagaactacaagctggtcaacagacagcggcagcagaagcaggcccagagccatcagagacacaaagcccagaagagaagcggcaccgaccagttcggagattctgagctgggacagcacatcgaccggctgctggctaaagccatcgtggcctttgctcactctcagagcgccggctctatcgtggtgcccaaactggaagatatccgcgagatcgtgcagagcgagatccaggccagagccgaggaaaaggtgccaggctatatcgagggccagaagcagtacgccaagagatacagagtgcaggtccaccagtggtcctacggcagactgatcgacagcatcaagagcaaggccacacagcagcaggtcgtgatcgaagagggaaagcagcctgtgcggggatctcctgaagctcaggctacagaactggccatcagcacctaccacctgagagcctctagctga

SEQ ID NO: 1229 - DNA, 520 bp, Spirulina major
gaaagaaatccgccactttccgtaccttgacaatagaatagagataatcgcgccgtaggtcatgttctttcagaaccgctgaactacgaaaaatatgggctagtttgcttgtttgacagcaagtgtgctttctggccctggtagctgtccgccctgatgctgatttctgcacaccttaatagcagaaatgattaacttgagaaatgaaacgcttgtgccttcattttacgaggtcggtgcgctcccagcaataagagtgtgggtttaccacagtgatggctaccgaatcacccccgaccaagggggaatccaccccaatcttctcatttctggcgtatacgaagcggggtcaaaatccccaagaggttcgccaaaatgggaaacccctttctcaatctgctttctaggcttttgatctggtctttcagggcagttaacccaaagccaacagcgacgtttccggcagatctgccaaaactgaggtgggaaagcagtctggataaggcttcaccagggagcg

SEQ ID NO: 1230 - DNA, 37 bp, Spirulina major; identical to SEQ ID NO: 822

SEQ ID NO: 1231 - DNA, 572 bp, Spirulina major
  misc_feature (549)..(572): n is a, c, g, or t
gaaagaaatccgccactttccgtaccttgacaatagaatagagataatcgcgccgtaggtcatgttctttcagaaccgctgaactacgaaaaatatgggctagtttgcttgtttgacagcaagtgtgctttctggccctggtagctgtccgccctgatgctgatttctgcacaccttaatagcagaaatgattaacttgagaaatgaaacgcttgtgccttcattttacgaggtcggtgcgctcccagcaataagagtgtgggtttaccacagtgatggctaccgaatcacccccgaccaagggggaatccaccccaatcttctcatttctggcgtatacgaagcggggtcaaaatccccaagaggttcgccaaaatgggaaacccctttctcaatctgctttctaggcttttgatctggtctttcagggcagttaacccaaagccaacagcgacgtttccggcagatctgccaaaactgaggtgggaaagcagtctggataaggcttcaccagggagcggaaatcccacgttgggatggattgaaagnnnnnnnnnnnnnnnnnnnnnnnn

SEQ ID NO: 1232 - DNA, 500 bp, Spirulina major; identical to SEQ ID NO: 823

SEQ ID NO: 1233 - DNA, 500 bp, Spirulina major; identical to SEQ ID NO: 824

SEQ ID NO: 1234 - DNA, 1686 bp, Trichormus variabilis
atgctggaaacccaggacaacaagcccaacgacgacgaagtgaagggcagcgacatcatcaccgaactgtctgccggcgacaaagagctgctggaactgatccagaagctgctcgagccctgcgacagaaccacatacggcgagagacagagagaggtggccgccaagctgggaaagtctgtgcggacagttagacggctggtcaagaagtgggaagaacagggacttgccggcctgcagacaacccagagagccgataagggcaagcaccggatcgatagccagtggcagaagttcatcatcaacacctacaaagagggcaacaagggcagcaagcggatcacccctcagcaggttgccattagagtgcaggccaaagccgctgagctgggcgacgagaattaccccagctaccggaccgtgtacagagtgctgcagcccatcatcgaggaacaagagcagaaggccggcgtcagaaacagaggctggcgaggctctagactgagcctgaaaaccagagatggcctggacctgagcgtggaatactccaaccacatctggcagtgcgaccacaccagagccgatctgctgctggttgatcagcacggcgaactgctggccagaccttgggtcaccacagtgatcgacacctacagccggtgcatcatcggcatcaacctgggctttgatgcccctagctctcaggtggtggctctggctctgagacacgccatcctgcctaagaagtacggcagcgagtacggcctgcacgaggaatggggcacatatggcaagcccgagcacttctttaccgacggcggcaaggacttcagaagcaaccatctgcagcagattggcgtgcagctgggcttcgcctgccatctgagagatagacctagcgaaggcggcatcgtggaaagacctttcggcaccctgaacaccgacctgttttctgccctgcctggctacaccggcagcaacgtgcaagaaagacctgaggaagccgagaaagaggcctgtctgaccctgagagagctggaaagactgatcgtgcggtacatcgtggacaagtacaaccagagcatcgacgccagactgggcgatcagacccggtatcagagatgggaggccggactgattgtggcccctagcctgatcagcgaagaggacctgagaatctgcctgatgaagcagacccggcggagcatctacagaggcggctatctgcagttcgagaacctgacctaccggggcgaaaatctggccggatatgccggcgaaagcgtggtgctgagattcgaccccaaggacatcaccaccatcctggtgtacagacagaccggcagccaagaagagttcctggccagagcctacgctcaggacctggaaaccgaagaactgtccctggatgaggccaaggccatgagcagaagaatccggcaggccggaaaagagatcagcaacagatccatcctggccgaagtgcgggaccgcgagacattcgtgaagcagaaaaagaccaagaaagagcgccagaaagaggaacaggtcgtcgtcgagaaagtgaagaaacccgtgatcgtggaacccgaagagatcgaggtggccagcgtggaaacagtgtccgagcctgatatgcccgaggtgttcgactacgagcagatgcgcgaggactacggctggtaa

SEQ ID NO: 1235 - DNA, 837 bp, Trichormus variabilis
atgacatctcagcaggccgagtctgtggcccaagagctgggagacatccctcagaacgacgagaagctgcaggccgaaatccagcggctgaacagaaagagcttcatccctctggaacaagtgaagatgctgcacgactggctggacggcaagagacagagcagacagtctggcagagtgctgggcgagagcagaaccggcaagaccatgggctgtgacgcctacagactgcggcacaagcctaagcaagagcccggcaaacctcctacagtgcccgtggcctacatccagattcctcaagagtgcagcgccaaagagctgttcgccgccatcatcgagcacctgaagtaccagatgaccaagggcaccgtggccgagatcagagacagaaccctgagagtgctgaaaggctgcggcgtggaaatgctgatcatcgacgaggccgaccggttcaagcccaagacctttgctgaagtgcgggacatcttcgacaagctggaaatcgccgtgatcctcgtgggcaccgatagactggatgccgtgatcaagcgggacgaacaggtgtacaaccggttcagggcctgccacagatttggcaagttcagcggcgaggacttcaagcggaccgtggaaatctgggagaaacaggtgctgaagctgcctgtggccagcaacctgtctagcaaggccatgctgaaaaccctgggcgaagccacaggcggctatatcggactgctggacatgatcctgagagagagcgccattcgggccctgaagaagggcctgtctaagatcgacctggaaaccctgaaagaagtgaccgccgagtacaagtga

SEQ ID NO: 1236 - DNA, 504 bp, Trichormus variabilis
atggaagtgggcgagatcaacccatggctgttccaggtggaaccctatcctggcgagagcctgtctcacttcctgggcagattcagacgggccaacgatctgaccacaaccggcctgggaaaagccgctggtgttggcggagctgtggccagatgggagaagttcagattcaaccctccacctagccggcagcagctggaagccgtggctaaagtcgtgggagtcgacgccgatagactggaacagatgcttcctcctgccggcgtgggcatgaacctggaacctattagactgtgcgccgcctgctacgtggaaagcccttgtcacagaatcgagtggcagttcaaagtgacccagggctgccagcaccaccacctgtctctgctgagcgagtgccctaattgcggcgccagattcaaggtgccagctctgtgggttgacggctggtgccagagatgctttctgccctttggcgagatggtggaacaccagaagggcatctga

SEQ ID NO: 1237 - DNA, 1908 bp, Trichormus variabilis
atgagccagatcaccatccagtgcagactggtggccagcgagagcacaagacagcagctgtggcagctgatggccgagaagaacacccctctgatcaacgagctgctcagccagatcggaaagcacgccgagtttgagacatggcggcagaagggcaaacaccccaccggcattgtgaaagagctgtgcgagcccctgaaaacagaccccagattcatgggccagcctgccagattctacaccagcgctaccgccagcgtgaactacatctacaagagttggttcgccctgatgaagcggttccagagccagctggatggcaagctgagatggctggaaatgctgaacagcgacgccgagctggtggaagctagcggagtgtctctggatgtgctgcagacaaagagcgcccagatcctggctcagttcgcccctcagaatcctgccgaaacacagcccgccaagggcaaaaagaccaagaaaggcaagaagtcccctaccagcgacagcgagagaaacctgagcaagaacctgttcgacgcctacagcaacaccgaggacaacctgaccagatgcgccatctcctacctgctgaagaacggctgcaagatcagcaacaaggccgagaatcccgacaacttcgtgcagcggcggagaaaggtggaaatccagatccagcggctgaccgagaagctggccgccagaattcctaagggcagagatctgaccaacaccatccggctggaaaccctgttcaacgccacacagaccgtgcctgagaacgagacagaggccaagttctggcagaacatcctgctgcggaagtccagccagctgccttttccagtggcctacgagacaaacgaggacctcgtgtggttcaagaatcagttcggccggatctgcgtgaagttcagcggactgagcgagcacaccttccagatctactgcgacagcagacagctgcagtggttccagcggttccttgaggaccagcagatcaagaagaactccaagaaccagcacagcagcgccctgttcacactgagaagcggcagaatcagctggcaagaggaacaaggcaagggcgagccctggaacatccaccacctgacactgtactgcagcgtggacaccagactgtggaccgaagagggcaccaacctggtcaaagaagagaaggccgaggaaatcgccaagacaatcacccagaccaaggccaaaggcgacctgaacgataagcagcaggcccacctgaagagaaagaacagcagcctggccagaatcaacaacccatttcctagacctagccagcctctgtacaagggccagagccatatcctcgtgggagtgtcactgggcctcgaggatcctgccacaattgctgtggtggacggcaccacaggcaaggtgctgacctaccggaacatcaaacagctgctcggcgacaactacaagctgctgaaccggcagcggcagcagaaacatctgctgagccaccagaggcacattgcccagagaatgagcgcccctaaccagttcggcgattctgagctgggcgagtacatcgaccggctgctggccaaagagatcattgctatcgcccagacctacaaggccggcagcatcgtgattcccaagctgggagacatgagagagcagatccagtccgagatccagagcaaggccgaacagaagtccgacatcatcgaggtgcagcagaagtacgccaaagaataccggaccaccgtgcaccagtggtcttacggcagactgatcgccaacatccagtctcaggccgccaagaccggaatcgtgatcgaggaaggcaagcagcccatccgggcctctccacaagagaaagccaaagagctggccattagcacctaccagagccggaaagcctga

SEQ ID NO: 1238 - DNA, 463 bp, Trichormus variabilis
ttgacaaaataccgaaccttgataatagaatagtaattaacaatagcgccgcagttcatgtttttaataaacctctgtcctgtgataaatgcgggttagtttgactgttgtgagacagtcgtgctttctgaccctagtagctgcccaccttgatgctgctgtttctagtaaacaggaataaggtgcgcccccagtaatagaggtgcgggtttaccgcagtggtggctaccgaatcacctccgagcaaggaggaatccaccttaattatttatttttggcgaaccataagcgaggtcaaaaaccctggggttctgccaaaagtccaaatcccttgtctaatctgtgtttcggatgtttagatgcttcaataattctcttttgagaggaaaatttagagcagatttaggacattcgccaaaattgcttttggaagtgtcttcagataagggtttggtcgggcgga

SEQ ID NO: 1239 - DNA, 37 bp, Trichormus variabilis; identical to SEQ ID NO: 1194

SEQ ID NO: 1240 - DNA, 515 bp, Trichormus variabilis
  misc_feature (492)..(515): n is a, c, g, or t
ttgacaaaataccgaaccttgataatagaatagtaattaacaatagcgccgcagttcatgtttttaataaacctctgtcctgtgataaatgcgggttagtttgactgttgtgagacagtcgtgctttctgaccctagtagctgcccaccttgatgctgctgtttctagtaaacaggaataaggtgcgcccccagtaatagaggtgcgggtttaccgcagtggtggctaccgaatcacctccgagcaaggaggaatccaccttaattatttatttttggcgaaccataagcgaggtcaaaaaccctggggttctgccaaaagtccaaatcccttgtctaatctgtgtttcggatgtttagatgcttcaataattctcttttgagaggaaaatttagagcagatttaggacattcgccaaaattgcttttggaagtgtcttcagataagggtttggtcgggcggagaaatcccgaagtggggcgggttgaaagnnnnnnnnnnnnnnnnnnnnnnnn

SEQ ID NO: 1241 - DNA, 600 bp, Trichormus variabilis
atcgctctttccctatcaaattatactagaaaaagtgaatcttcctgtgctgataacaacaacataaactgcttcccctgacctgaaggtttcaacggttcctagaagaccaagaaattaataaaaatagtaaaaatcaacattctagtgccttgtttaccatgcatagtggtcgtatcgcttggcaggacgaacaaggcaagtgagaaccctggaatattattttgtcgcttgtcaaattaaatgaccacttgacaaattaatgtccacaaatatattaaccgctaaacccttacacagtgagggttttaatattttagcctatttttagccagtcagatactaattgacaaaataactgtccgaacttgaatatttgacaaattaattgtcctgtattgaaaatccctatttttccaatttttccagacttgacaaattaattgtccttttatacagtacaatacaactatgtttgtaataaacatatatgctagaaactcaagataataaacccaatgatgatgaggtaaaaggtagtgacattatcaccgaactatccgcaggtgataaggaactattggaactaatccaaaaatt

SEQ ID NO: 1242 - DNA, 500 bp, Trichormus variabilis
gtttcaacacccctcccgaagtggggcgggttgaaagtctaaattttgtcttctgtttcagagcctaataaattaaaacactgttataaaattaaggtgggttgaaaggagtgctgcgatcgtacacaacataagttatgtgtattacctggagataaaatttaaggacaaataatttggcagcacggacagcaatttggcaagacggacaacaatttgtcaacgcggacaaattatttggcaagtgacaacaatttataatggagaataggagactcgaacccctgacctctgcggtgcgatcgcagcactctaccaactgagctaattccccttgtgagtgcagagtagcaaactctgacagacgtactctatcttaacactcaggcacggcagattttacatctttttgcaaatacacctgctgcacccgttccaattccaaatcagtcaaataatctacagtccagttggcttgacgctgaagcatatgaaaaggg

SEQ ID NO: 1243 - DNA, 1698 bp, Nostoc piscinale
atgcccgacaaagagtttggactgaccggcgagctgacccaagtgacagaagccatcctgctgggcgagagcaacttcgtggtggaccctctgcacatcatcctggaaagcagcgacagccagaagctgaagttcaacctgatccagtggctggccgagtctcccaacagacagatcaagagccagcggaagcaggccgtggccgagacactgagcatcagcacaagacaggtggaacggctgctgaaagagtacaacgaggaccggctgaacgagacagctggcgtgcagagaagcgacaagggcaagcacagagtgtccgagtactggcagcagtacatcaagaccatctacgagaacagcctgaaagagaagcaccctatcagccccgcctctgtcgtgcgggaagtgaagagacacgccatcgtggatctgggactcgagcagggcgattaccctcatcctgccaccgtgtaccggatcctgaatcctctgatcgagcagcagcagcggaagaagaagatcagaaaccctggcagcggcagctggctgaccgtggaaacaagagatggcaagcagctgaaggccgagttcagcaaccagatcatccagtgcgaccacaccgagctggacatccggatcgtggacaacaatggcgtgctgctgcccgaaagaccttggctgacaaccgtggtggataccttcagcagctacgtgctgggctttcacctgtggatcaagcagcctggaagcgccgaagttgccctggctctgagacacagcatcctgcctaagcagtaccccaacgactacgagctgagcaagccttggggctacggccctccattccagtactttttcaccgacggcggcaaggacttcagatccaagcacctgaaagccatcggcaagaaactgggatttcagtgcgagctgcgggacagacctaatcaaggcggcatcgtggaacggatctttaagaccatcaacacccaggtgctgaaggacctgcctggctacacaggcagcaacgtgcaagagaggcctgagaacgccgagaaagaggcctgtctgaccatccaggacatcgacaaagtgctggccggcttcttctgcgacatctacaaccacgagccttatcctaaggaccccagagacaccagattcgagagatgggtcaaaggcatgggcagaaagctgcccgagcctctggatgagagagagctggatatctgcctgatgaaggaagcccagagagtcgttcaggcccacggcagcatccagttcgagaacctgatctacagaggcgagagcctgaaggcctacaagggcgagtacgtgaccctgagatacgaccccgatcacatcctgacagtgtacgtgtacagctgcgagagcgacgacaacctggaagagtttctgggctacgcccacgccatcaacatggacacacacgacctgtctctggaagaactgaaggccctgaacaaagagcggagcaaggcccggaaagagcacttcaattacgacgccctgctggccctgggcaagagaaatgaactcgtgggcaaacgcaaagaggacaagaaagagaaacggcggagcgagcagaagagactgagatccaccagcaagaaaaactccaacgtggtggaactgagaaagagcagagccgccagcagctccaagaagagatga

SEQ ID NO: 1244 - DNA, 855 bp, Nostoc piscinale
atggccagatctcagctggccacacagcccatcgttgaagccctggctcctcacctgtctctgaaggcccagatcgccaagaccatcgacatcgaggaaatcttccggacctgcttcatcaccaccgacagagccagcgagtgcttcagatggctggacgagctgcggatcctgaagcagtgcggcagaatcatcggccccagaaacgtgggcaagagcagagctgccctgcactacagagatgaggacaagaaacgggtgtcctacgtgaaggcttggagcgccagcagcagcaagagactgttcagccagattctgaaggacatcaaccacgccgctcctaccggcaagagacaggatctcagacctagactggccggcagcctggaactgttcggactggaactggtcatcatcgacaacgccgacaacctgcagaaagaggccctgctggacctcaagcagctgttcgaggaatgccacgtgccaatcgtgctcgtcggcggaaaagagctggacgacattctgcaggactgcgacctgctgaccaactttcccacactgtacgagttcgagcggctggaatacgacgacttcaagaaaaccctgagcaccatcgagctggatatcatcagcctgcctgagagcagcaacctgagcgagggcaacatcttcgagatcctggctggctctacaggcggcaggatgggcatcctggtcaagatcctgacaaaggccgtgctgcacagcctgaagaacggcttctctaaggtggacgagagcatcctggaaaagatcgccagcagatacgggaccaagtacatccctctggaaaaccggaaccggaacgagtga

SEQ ID NO: 1245 - DNA, 564 bp, Nostoc piscinale
atgctggtggttatggtgcagaacatcttcctgagcaagaccgagatcggcatgaacgaggacgagatcagacccaagctgggctacgtggaaccttacgagggcgagagcatcagccactacctgggcagactgcggagattcaaggccaactctctgcccagcgcctacagcctgggaaagattgctgatctgggcgccgtgacaggcagatgggagaagctgtacttcaaccccagacctacacagcaagagctggaagccctggcctctgtggtggccgtgaatgccgatagactgaccgagatgctgcctcctaccggcatgaccctgaagcctagacctatcaagctgtgcgccgcctgctatgccgaggaaccctatcacagaatcgagtggcagtacaaagaacagcagaaatgcgtgcggcacaacctgcggctgctgaccaagtgcatcaactgcgagacaccctttcctatacctgccgactgggtggaaggcgagtgtcctcactgtagcctgagcttcgccaagatggccaagcggcagcggagaaactaa

SEQ ID NO: 1246 - DNA, 1908 bp, Nostoc piscinale
atgagcgtgatcaccatccagtgcagactggtggccggcgaggataccctgagaacactgtgggaactgatggccgacaagaacacccctctggtcaatgagctgctggcccaagtgggaaagcaccccgagtttgagccctggctggaaaagggcaagatccccaccgagtttctgaaaaccctggtcaacagcctcaagacccaagagagattcgccgaccagcctggcagattctacacctctgccattgctctggtggactacgtgtacaagagttggttcgccctgcagaagcggcggaagagacagatcgagggcaaagagagatggctgaccatcctgaagtccgacctgcagctggaacaagagtcccagtgcagcctgaacgccatcaggaccaaggccaacgagatcctgaccaagctgacccctcagagcgagcagaacaagaaccagcggaagtctaaaaagaccaagaagtccgccaagctgcagaagtccagcctgttccagatcctgctgaacacctacgagcagactcaagagacactgacccactgcgccattgcctacctgctgaagaacaactgccagatcagcgagctggaagaggacagcgaggaattcaccaagaaccgccggaagaaagagattgagatcgagcggctgaaggatcagctgcagagcagaatccccaagggcagagatctgaagggcgaagagtggctgaaaacactggaaatcagcaccgccaacgtgccccagaacgagaatgatgctaaggcctggcaggccgctctgctgagaaaatctgccgacgtgccatttcctgtggcctacgagagcaacgaggacatgacctggctgcagaatgagaagggcagactgttcgtgcggttcaacggcctgggcaagctgacattcgagatctactgcgacaagcggcatctgcactacttcacccggtttctggaagatcaagagatcaagcggaacagcaagaatcagtacagcagctccctgttcaccctgcggagtggtagacttgcttggagcccaggcgaagatagaggcgagccctggaaagtgaaccagctgcacctgtactgcagcctggacaccagaatgtggaccatcgagggaacacagcaggtcgccgatgagaaaagcaccaagatcaccgagactctgacaaaggccaagcagaaggacgagctgaacgacaagcagcaggccttcatcaccagacagcagagcaccctggaccggatcaacaacccatttcctcggcctagcaagcccaactaccagggccagccttctatcctcgtgggcgtgtcctttggcctggaaaagcctgtgacagtggccgtggtggacgtgatcaagaacgaggtgctggcctacagaagcgtgaaacagctgctgggcaagaactacaatctgctgaaccggcagcgccagcagcagcagagactgtctcacgagagacacaaggcccagaagcggaacgcccctaatagctttggcgagtctgagctgggccagtacgtggacagactgctggctgatgccatcctggccattgccaagacataccaggccagctccatcgtgatccccaagctgagagacatgagagagcagatcaccagcgagatccagagcagagccgagaagaagtgccccggcaacaaagaggtgcagaagaaatacgccaaagaataccggatgagcgtgcaccggtggtcctatggcagactgatcgagagcatcaagagccaggccgccaagaccggcatctttaccgagattggcacccagcctatccggggctctcctcaagagaaagccagggacctgaccgtgttcgcctatcaagaaagacaggccagcgtgatctga

SEQ ID NO: 1247 - DNA, 496 bp, Nostoc piscinale
ttcactaatctgaaccttgaaaatataatatttttataacagcgccgtagttcatgctcttttgagccaatgtgctgcgaaaaatctgggttagtttggcggttggaagaccgtcatgctttctgaccctggtagctgcccgcttctgatgctgccatctttagaattctataggtgggataggtgcgctcccagcaataaggagtaaggcttttagctgtagccgttattcataacggtgtggattaccacagtggtggctactaaatcacccccttcgtcgggggaaccctcccaaatatttttttggcgtgtcaaagtgggggcaaaatccccggagtcccgccaaaactttaaaacccttatccagtcttgaattaagaaactagtatgtcaataaatttagtattttaattttcagatcgagactattttaagctgacctgccaaagtatgtgtatggaaagctttgatagcaagggttctagacgggtcg

SEQ ID NO: 1248 - DNA, 37 bp, Nostoc piscinale
gtttcaacaagcatcccggctaggggtgggttgaaag

SEQ ID NO: 1249 - DNA, 548 bp, Nostoc piscinale
  misc_feature (525)..(548): n is a, c, g, or t
ttcactaatctgaaccttgaaaatataatatttttataacagcgccgtagttcatgctcttttgagccaatgtgctgcgaaaaatctgggttagtttggcggttggaagaccgtcatgctttctgaccctggtagctgcccgcttctgatgctgccatctttagaattctataggtgggataggtgcgctcccagcaataaggagtaaggcttttagctgtagccgttattcataacggtgtggattaccacagtggtggctactaaatcacccccttcgtcgggggaaccctcccaaatatttttttggcgtgtcaaagtgggggcaaaatccccggagtcccgccaaaactttaaaacccttatccagtcttgaattaagaaactagtatgtcaataaatttagtattttaattttcagatcgagactattttaagctgacctgccaaagtatgtgtatggaaagctttgatagcaagggttctagacgggtcggaaatcccggctaggggtgggttgaaagnnnnnnnnnnnnnnnnnnnnnnnn

SEQ ID NO: 1250 - DNA, 500 bp, Nostoc piscinale
tgaagcaaaattaaagattgacttttcgagcctttgcgcgaaacaaaattcattcccttaatcagcaacgccaattaaaaaaatcatctctagaaagagattgacaaataatgtgtcgccacggacaaataatttgtacattcgcacgttatatgtcgcaatttgcaaataacgacatgagcgtttttatcatctaaaacgcttattttataaagctttcagaacatttttcactaaaaatataacattcctaaattcgcatattgaatgtcgcaaacactaatgttcgcaaattaacgccgttggtctaaattttgttaccttgcaaattcaatgtcgcattttcttaattcaatggtacattgatactatcaataactacattctcctcacttaaatgccagacaaagaatttggattaactggagaattgacacaagttacggaagctattttgcttggtgaaagtaattttgtggtcgatccattacacattattc

SEQ ID NO: 1251 - DNA, 500 bp, Nostoc piscinale
agtttcaacaagcatcccggctaagggtgggttgaaaggaaatttttgttgttactaggtgagatatttgtttcaattaggagggttgaaaggcgcacttcgttcgggaatattctgaaatttttagcatattctacaagtgtagtgggatcactccaccacatcacagttgcgacattaatttgcgaaaaatcagtataattaaattgactctaaaaataagtcaaagcgacgctaatttgcaaaaaaacgacattaatttgcatattgcgacacataatctgcgaatgtacatcgacacatgcacatcgggatgactggattcgaaccagcggccccttcgtcccgaacgaagtgcgctaccaagctgcgctacatcccgctaaaaaaaagacaatatttttatgattgtaccataaatatctgaaaaaaggaaatataaaaatcagctgctactgaactgtatagatgaccgaacaaggcaaaagtaaaaatttaaa

SEQ ID NO: 1252 - DNA, 1719 bp, Cyanothece species
atgaagaacgccaactctccacctagcaccagcagcgtgaacaaccctctggaaaaagagaacaacgtcatccccagcgagctgagcgacgaggcccaactgaagctggaagtgatccagacactgctgaagccctgcgacagaaagacctacggccagagactgcaagaggccgccgagaagctgggcaagagcaagagaacagtgcagcggctggtcaagaagtgggaagagaagggactgcaggccattgccgccaccgacagatctgataagggcagcttccggatcgaggaacagctgcaagagttcatcatcaagacctacaagaacggcaacaagggcagcagaagagtgacccggaaacaggtgtacctgaaggccaaggccaaagccgaggaactgggcatcaatcctccaagccacatgaccgtgtaccggatcctgcagcctctgatcgagaagcaagaaaagaagaagtccatcagaagccccggctggcggggatctcagctgtctgtgaaaacaagagccggccaggacctgagcgtggaatactccaatcacgtgtggcagtgcgatcacaccctggccgatatcctgctggtggatcagtatggcgagctgctgggtagaccttggctgaccacagtgatcgacacctacagccggtgcatcatcggcatcaacctgggcttcaatgcccctagcagccagattgtggccctggctctgagacacgccatcctgcctaagagatacacccctgactaccagctgtccgaggaatggggcacatacggcaagcccgagcacttctacaccgacagcggcaaggatttcagcagccaccacatccagcagatcagcgtgcagctgggcttcgtgtgccacttcagagacagacctagcgaaggcggcatcgtggaaagacccttcaagaccctgaacctggaattcttcagcaccctgcctggctacaccggcagcaatgtgcaagaaagacccgaggatgccgagaaagaggcctgtctgacactgcggcagctggaacagaaactcgtgcggtacatcgtggacaactacaaccagcggatcgacgccagaatgggcgaccagaccagattccagagatgggagtctggcctgatcgctagccccgatgtgatcagcgagagagagctggacatctgcctgatgaagcagaccagacggaaggtgcagagaggcggctacctgcagttcgagaacctgatgtaccggggcgagaatctggccggatatgccggcgagtctgtgatcctgagattcgaccccagagatgtgaccaccgtgctggcctaccagcaagagtccaatcaagaggtgttcctgaccagagcctacgccatcgacctggaaaccgagcagatgagcctggacgaagccaaggcctcctccaagagagttagagaggccggcaagaccatcagcaaccggtctatcctgagcgagatcagagccgccgagggatctgcctatgccgacagacagatcttccctaaggccaagaagtctaagaaagagcgctaccaagaggaacagaaggccatcaccagcaagcccctggaacaggtggaaagcgagctggaagaaaccgacgtgtccagcagcagctccgagacatctcaggtggaagtgttcgactacgaaacactccaagaggactacggcttctga

SEQ ID NO: 1253 - DNA, 837 bp, Cyanothece species
atgaccatccaagaggcccaggctgttgctcagcagctgggcgatatcaagctgaccagcgagaagctgcaggccgagatccagcggctgaacagaaagaccgtggtcaccctgtctcacgtggaagccctgcacaattggctggaaggcaagagacaggccaagcagagctgtagagtcgtgggcgagagcagaaccggcaagacaatcgcctgcaacgcctaccggctgcggcacaagcctattcagacacctggcaagcctccaatcgtgcccgtggtgtacatccaagtgacccaagagtgcggcgccaaggatctgtttggcgccatcatcgagcacctgaagtaccagatgaccaagggcaccgtggccgagattcggcagagaacctttaaggtgctgcagagatgcggcgtggaaatgctgatcatcgacgaggccgaccggctgaagcctaagacctttgctgaagtgcgggacatcttcgacaagctgaatatcgccgtggtgctcgtgggcaccgatagactggatgccgtgatcaagcgggacgaacaggtgtacaaccggttcagagcctgccacagatttggcaaactggccggcgacgagttcagccagacagtggatatctgggagagacaggtgctgaagctgcccgtggccagcaatctgagcagcaagcggatgctgaagatcctcggacaggccacaggcggctatctgggactgctggacatgatcctgagagagagcgccattcgggccctgaagaagggcctgcagaagatcgacctggaaaccctgaaagaagtgaccgaggaataccggtga

SEQ ID NO: 1254 - DNA, 402 bp, Cyanothece species
atggaaagcaaagaaatccagccgtggtggttcctggtgcagcctcttgccggcgagagcatctctcactttctgggcagattccggcgcgagaacgagctgaccgtgaccatgatgggcaagctgacaggactcggcggagccattgccagatgggagaagttcagattcatccccgctcctaccgaggaagaactgacagccctgtctgaggtggtgcaggtcgaggtggaaagactgtggcagatgttccctccaaaaggcgtgggcatgaagcacagacccatcagactgtgcgccgcctgctacgacgaggaaagatgtcacaagatcggctggctggtggaagatgacagcgtgctgctgaaggcctgggtcaacatcgtcgtgggaatgagctga

SEQ ID NO: 1255 - DNA, 1839 bp, Cyanothece species
atgagccagatcaccatccagtgccggctggtggccaaagaggccacaagacagacactgtggcagctgatggccgagctgaacacccctttcatcaacgagctgctgcaacaggtggcccagtatcctgactttgagcagtggcggcagagaggcagactgaccgccaaagtgattgagcagctgggcaatgagctgaagaaggaccccagattcctgggccagcctgccagattctacacctctggcatcagcctggtcgagtacatcttcaagagctggctgaagctgcagcagagactgcagagaaagctggacggcaagcggagatggctggaagtgctgaagtctgacgagcagctgatcaaggacagccagaccgacctggaaaccatcagacagaaggccaccgagatcctgcagagctacgagggcaccgagagactgttcaacagcctgttccaggcctaccgggacgagcagaacatcctgacacagacagccctgaactacctgctgaagaaccggtgccagctgcctaagaaacccgaggacgccaagaagttcgccaagcggcggagaaaggtggaaatcaccatcaagcggctgcagaagcagatcaacggcagactgcctcagggcagagatctgaccaacgacaactggctggaaaccctgaacctggcctgcgacaccgatcctaaggacgtggaacagagcagaacctggcaggacaagctgctgaaaaagagccagagcatcccctttccaatcaactacgagacaaacgaggacctgacctggtccaagaacgagaagggcagattctgcgtgcagtttaacggcatcagcgacctgaagttcgagatctactgcgaccagcggcagctgaagtggatccagagattctacgaggaccagcaagtgaagaaagacggcaaggatcagcacagcagcggcctgtttacactgcggagcggaagaatcctgtggcaagaaggcaaaggcaagggcgagctgtgggacatccacagactgactctgcagtgcaccctggaaacacggtgttggacccacgaaggcaccgaacaagtgaaacaagagaaggccgatgagatcgccggcatcctgaccaggatgaatgagaagggcgacctgaccaagaaccagaaagccttcgtgcggcggaagcagagcaccctgaatagactggaaaagccctttccacggcctagccagcctctgtaccagggcaagagcaatatcctcgtgggcgtgtccatggaactgaagaagcctgccacaatcgccgtgatcgatggcgtgaccagaaaggtgctgacctaccggaacatcaaacagctgctgggcaagaactaccctctgctgaaccgacagcagcgccagaaacagagacagagccaccagcggaatatcgcccagcggaaagaggccttcaaccagttcggcgattctgagctgggacagcacatcgatagactgctggccaaggccatcatctcaatcgcccagaagtaccaggccggcagcatcgtggtgcccaagctggaagatatccgcgaggccacacagagcgagatccaggccaaagccgaggccaagattcccaactgtattgaggcccaggccgagtatgccaagaaataccggatgcaggtccacgagtggtcctacggcaggctgatcgacaacattcaggctcaggccagcaagctgggcatcttcatcgaggaaagccagcagcctctgcagggcacacctctgcagaaagctgccgagctggccttcaaggcctacagatctagactgagcgcctga

SEQ ID NO: 1256 - DNA, 737 bp, Cyanothece species
aactttcatctgaaccttgacaatttaatatggtatttttatactaaagagtataaattagtcgcgcaccgtaaattatgttcttaattgaacctctagattacggaaaagggttagtttgactgtcggtagatagttttgctttctggccctagtagctgtccaccctgatgctgatttctacaatttagattgtagggataataacctgtaaaaagagattagctgataatttcattttatggggaaggtgcgctcccagcaataagtggcgtgggtttaccacagcgatggctactgaatcacctccgaccaaggaggaatccacttattttttcttactaatgacgggataaggcatggtcaaagatatagttaaatttatagagtttaagtagattgaaagcgagtccagttacgtcctatgagattacatcgttgtggagtttgctctcaagatgtttgattgtgcaagggcgcaggtgcgatgctgtaatttttactaagtcattctagactaacgtgaaatcctttctcaatcttagtttgaagcgtgtaaaagcaactatttttttgtagttgtctagcgcaaaccccgaacccgttattagatataggttatggcatttctcagtgttcatttttttaaaggcctgtggctgaaatgaacttttgagtcttgtccagcgcagatagttaataaaacccttaacacataaggtttttagactcctgtc

SEQ ID NO: 1257 - DNA, 37 bp, Cyanothece species
ctcgcaatctattttgattgatgaaatggattgaaag

SEQ ID NO: 1258 - DNA, 789 bp, Cyanothece species
  misc_feature (766)..(789): n is a, c, g, or t
aactttcatctgaaccttgacaatttaatatggtatttttatactaaagagtataaattagtcgcgcaccgtaaattatgttcttaattgaacctctagattacggaaaagggttagtttgactgtcggtagatagttttgctttctggccctagtagctgtccaccctgatgctgatttctacaatttagattgtagggataataacctgtaaaaagagattagctgataatttcattttatggggaaggtgcgctcccagcaataagtggcgtgggtttaccacagcgatggctactgaatcacctccgaccaaggaggaatccacttattttttcttactaatgacgggataaggcatggtcaaagatatagttaaatttatagagtttaagtagattgaaagcgagtccagttacgtcctatgagattacatcgttgtggagtttgctctcaagatgtttgattgtgcaagggcgcaggtgcgatgctgtaatttttactaagtcattctagactaacgtgaaatcctttctcaatcttagtttgaagcgtgtaaaagcaactatttttttgtagttgtctagcgcaaaccccgaacccgttattagatataggttatggcatttctcagtgttcatttttttaaaggcctgtggctgaaatgaacttttgagtcttgtccagcgcagatagttaataaaacccttaacacataaggtttttagactcctgtcgaaattgattgatgaaatggattgaaagnnnnnnnnnnnnnnnnnnnnnnnn

SEQ ID NO: 1259 - DNA, 498 bp, Cyanothece species
aacttcatcacgtgctttcttccatccaagctgaaaaccatcatgatatttgacttgaaaaacccattcttttggtacgtcctcaattacattgataggtgtacagtaactaattgtttgtcgtcttaacaaaatagtgtcgtcaaaacttttaaccttcaaacttttatataatctacgttatagactgatcataacatcaatcttttataaaagtcattattcatcttattaacaaattgactgtcatttacccgaatggcactttttttatggactgaagcaatattaacaaattaattgtctccaaacttcaaggattgtgatacactcatattaaataaacaattatgtaataatcagacattgttgttcattatgaaaaatgcaaactcaccaccctctacatcatcagttaataatcccttagagaaagaaaataatgttatcccctctgagttatctgatgaagcacaattaaagcttgaggttattcaa

SEQ ID NO: 1260 - DNA, 500 bp, Cyanothece species
cagcgtcacaatctattttggttaatgagatggattgaaagattttttaccatcgtctaggattagtctcggtaataggcacacgacaaataatatgttcttaatgacacccaattcgttaaagcgacaataatttgttaccgatgacaaataatcagttactgtacaaaactttaaattacaagttaatattatacacactataaaaaaatatggacgtaactggactcgaaccagtgaccccatcgatgtcaacgatgtactctaaccaactgagctatacgtccgcacaagtctttactataacacaagatttaccaaaaacgcaaataaacaaacaaacttacatagatttccttaagagatgggggagtcggggtcattggggagtgtaataaaaggacaacccttgattattgatcattatatgtacgagaaactgacaccccccaccactggttctaaaatcacttttaaagacggtaaacccattgttccta

SEQ ID NO: 1261 - DNA, 1641 bp, Aphanocapsa montana
atggaactggtcaaccccgacgacctgaacagcgtggaaagccggctgaagctggaaatcatcgagaagctgagcgagccctgcgacagaaagacctacggcgagagactgagaagcgccgctcagcagctgaagtgttctgtgcggacagtgcagcggctgatgaagaagtgggaagaagaaggcctggccgctctgatcgacagcggcagaatcgataagggcaagcccagaatcgccgaggactggcagcagttcatcaagaaggtgtacagcaacgacaagtgcacccctgctcaggtgttcaccaaagtgcggaacaaggccagacaagagggcctgaaggactaccccagccacatgaccgtgtaccggatcctgagactggtcaaagaggccaaagagaaagaggaatccatccggaacctcggctggaagggatctagactggccctgaaaaccagagatggcgaggtgctggaaattgactacagcaatcaagtgtggcagtgcgaccacaccagagccgatatcctgctggtggataagtacggccaccagatgggcagaccttggctgaccacagtgatcgacacctacagcagagccatcgtgggcatcaacctgggctacgatgccccttctagcagcgttgtggctctggctctgcggaacgccatcatgcctaagcagtacggcgtcgagtacaagctgtacgccgattggcctacctgcggcacacctgatcacctgtttaccgacggcggcaaggacttcagaagcaaccacctgagacagatcggcctgcagctgggcttcatctgtcacctgagagacagacctagcgaaggcggaatcgtggaaagacccttcggaacaatcaatacccagttcctgagcaccctgcctggctacacaggcagcaacgtgcaggatagacctcctgaggccgaagccgaagcctgtctgacactgcaagagctggaaaagctgctggtcgcctacatcgtgaatacctacaaccagcggctggacgccagaatgggcgatcagaccagaattcagagatgggaagccggcctgctgaagcagcctagagtgatccctgagcacgagctgcacatctgcctgatgcggcagaccagacggaccatctacagaggcggctacctgcagttcgagaacctggcctatagaggcgaagccctggctgaacatgccggcgagaatatcgtgctgagatacgaccccagaaatatcgcccaggtgctggtgtacagacacgaccccgacagagaagtgtacctgggagttgcccaggctctggaattcgagggcgaagtgctggccctggatgatgccaaggctcacagcagacggatccgcgaggatggaaaggccgtgtccaatgacgccatgctggacgagatgcgggatcgcgaagccttcgtggaccagaagaacaagagccggaaggaccggcagaaggacgagcaggctgatctgaggcctaccacacctcctatcatcggccctgatagcagcgacgagccttccgtggatgtccagcctgatgagagccccgaggaactggatatccccgagttcgacatctgggacttcgacgacgacgatgcctga

SEQ ID NO: 1262 - DNA, 813 bp, Aphanocapsa montana
atgatcgccctgcaggaccaagaagtgcaggcccacattgagcggctgcggagagataagacagtggccctggatagcgtgaagcaggcccatacctggctgaagcggaagagaaacgccagacagtgcggcagactgaccggcgattctagaaccggcaagaccaagacctgcgagagcttcctgaagctgtacggcgagcctgatctgagcggcagagtgcctatcatccccatcagctacgtgcaccccaagcaagagtgcaccagcagagagctgttcagagagatcctggaacagtacggcgacgacctgcctagaggcacagtgggagatgccagatctcggaccctgaaggtgctgagagcctgcaagaccgagatgctgatgatcgacgaggccgacagactgaagcccaagacctttgccgacgtgcgggacatcttcgacaagctggaaatcagcgtgatcctgatcggcaccaagcagcggctggatcccgccgtgaagaaagacgaacaggtgttcaaccggttcagaagcagctaccggatcggcacaatccccagcaaccagctgaaaaccatcgtcggcctgtgggagagagacattctgaagctgcccgtgcctagcaacctgacctctgaggccatgctgaaagagctgagaaaggccaccggcgtgtcccggaagggctattatatcggcctgatcgacatggtgctgcgcgaggctgctatcagagccctggaaaagggccagagcaagatcgagctggaaaccctgaaagaggtggccaaagagtacagctga

SEQ ID NO: 1263 - DNA, 498 bp, Aphanocapsa montana
atggtcatccctcagatccctgcctgggtgttccccgtggaaccttctcctggcgaatccctgtctcacttcctgggcagattctgcagagagaaccacaccacactgaaccagctgggcgagaaaacaggactgggagccgtgctcggaagatgggagaagttccggttcatcccacagcctagcgacgctcaactggccgctctggccaaactcgtcagactggaagtggaccagatcaagcagatgctgccccaagagacaatgcagaacagagtgatcagactgtgcgccgcctgctacgccgaggaaccttatcacagaatcgagtggcagtacaagctggccaacagatgcgaccggcaccatctgttgctgctgctggaatgccccaactgcaaggccaagctgcccatgcctagcaagtgggccaatggcacatgcaagcggtgtctgacccctttcgagcagatggccgatctccagaagggcatctga

SEQ ID NO: 1264 - DNA, 1971 bp, Aphanocapsa montana
atggtgcagatgaactacatctgcgccctgagcatcaagttcgtgatgagcaagatcaccatccagtgccggctggtggccagcgaagccacaagacagtatctgtggcacctgatggccgacatctacacccctttcgtgaacgagatcctgcggcagatcagagaggacgacaacttcgaacagtggcggcagagcggaaagatccctgcctccgtgttcgaggactacagaaagaccctgaaaaccgagagccggttccagggcatgcctggcagatggtattacgccggcagagaagaagtgaagcggatctacaagagctggctggccctgcggagaaggctgagaaatcaactggccggacagaaccggtggctggaagtgctgcagtccgacgagacactgatggaagtgtccggcctggatctgagcgctctgcaggctgaagctagccagctgctgaatatcctgggcagcaagaacaagaccagcaagaatcggagcaagaaggccaagggcaagcctaagggcaagagcgccaaggatcccacactgtatcaggccctgtgggagctgtacagagagacagaggatatcgccaagaaatgcgtgatcgcctacctgctgaagcacaagtgccaggtgccagacaagcccgaggatcccaagaagttcagacacaggcggagagaggccgagatcagagccgagagactgaacgagcagctgatcaagaccagactgcccaagggcagagatctgaccaacgagcagtggctgcaggtcctggaaatcgccactagacaggtgcccaaggacgaggatgaagccgccatctggcaaagcagactgctgaccgatgccgccaagtttccatttcctgtggcctacgagacaaacgaggacctgaagtggttcctgaacggcaaaggcaggctgtgcgtgtccttcaatggcctgagcgagcacaccttcgaggtgtactgtggccagagacagctgtactggttcaaccggttcctggaagatcagcagatcaagaaagagaaccagggcgagagaagcgccggactgttcacactgagaagcggcagactcgtgtggaagccctacagctctgacgccagcagatccgatccttggatggccaatcagctgaccctgcagtgtagcgtggacaccagactgtggacagccgagggaacagagcaagtgcggcaagagaaggccacctctatcgccaaagtgatcgccggcacaaaggccaaagggaacctgaaccagaagcagcaggacttcatcaccaagcgggaaaagacactcgagctgctgcacaacccatttccacggcctagcaagcctctgtaccagggaaagcccagcatcattgccgccgtgtctttcggcctggaaaagcctgccacactggccatcgtggacatcgtgaccgataaggccatcacctaccggtccatcagacagctgctgggccagaactacaagctgttcaccaagcaccggctgaaacagcagcagtgcgcccaccagagacaccagaatcaggtggaaagcgccgagaaccggatctctgaaggcggactgggagagcacctggatagcctgattgccaaggccatcctggaaacagccgccgagtatggcgccagctctattgtgctgcctgagctgggcaacatcagagagatcatccacgccgagattcaggccaaggccgagagaaagattcccggcctgaaagaaaagcaggacgagtacgccgccaaattcagagcctccgtgcacagatggtcctacggcagactggcccagaaagtgaccaccaaagccagcctgcacggactggaaaccgagtctacaagacagagcctgcagggcacccctcaagagaaagccagaaacctggccatcagcgcctacgagtctagaaaggtggcccagagagcctga

SEQ ID NO: 1265 - DNA, 418 bp, Aphanocapsa montana
caagttcgcacgtactactaaaatatacctagcgcctaagctcatgccgtcagtggcctctgtgctcagaaaaaaggctagtttgacggtctgaacaccgtcctgctttctggcccagatgactatccatccccgaagttgtgagcgcacgcagcaagagggcacgggttctggagtgatggttatcaagttcacctccgagcaaggaggaatccacccaaaacttaaaattggcaaacctaagcgaggtcaagatccctaggaggtttgccaaagttctaaagctctttatccacacaagtttgaacgagttgtttcgttcaaattgctagctccctagaatttttctgtagagttagattgagctttgccaaatttagcctgaaaagcttgtggggtatgcctttccgatggcaag

SEQ ID NO: 1266 - DNA, 37 bp, Aphanocapsa montana
gtcgccaaaagcatttcagggcagggcgggttgaaag

SEQ ID NO: 1267 - DNA, 470 bp, Aphanocapsa montana
  misc_feature (447)..(470): n is a, c, g, or t
caagttcgcacgtactactaaaatatacctagcgcctaagctcatgccgtcagtggcctctgtgctcagaaaaaaggctagtttgacggtctgaacaccgtcctgctttctggcccagatgactatccatccccgaagttgtgagcgcacgcagcaagagggcacgggttctggagtgatggttatcaagttcacctccgagcaaggaggaatccacccaaaacttaaaattggcaaacctaagcgaggtcaagatccctaggaggtttgccaaagttctaaagctctttatccacacaagtttgaacgagttgtttcgttcaaattgctagctccctagaatttttctgtagagttagattgagctttgccaaatttagcctgaaaagcttgtggggtatgcctttccgatggcaaggaaatttcagggcagggcgggttgaaagnnnnnnnnnnnnnnnnnnnnnnnn

SEQ ID NO: 1268 - DNA, 500 bp, Aphanocapsa montana
tattgggaaaattggttcaccgagatttaggccaaatggaggttgaaaaccaccattacatagataagtggccaatttaattcgcgaacgtacatgtcgcataacacgtaatccgtcgccataacacgctcttgtcgccgaccattaaatggctagacccctttgaattcaggaaccttggcgatttcatcctcactctaaagagcgctcttgaataacaaaatatttgacgcctcttgaagaatgaacacaatcagtgtcgtctctttgaagctgaaatcgcctcagtattaacgcactctttgtcgcctctttgcggctttgtcggatctgatctaacaaattagatgacatatcttggcgactatagtacatttgatttaattcacttgtactaggtgactccatggaacttgttaatccagatgatctgaattcagtagaatccaggctcaagctagaaattatcgagaaactttcagagccctgcgatcgcaaaa

SEQ ID NO: 1269 - DNA, 501 bp, Aphanocapsa montana
ggtcgccaaaagcatttcagggcagggcagattgaaatcgctagggcctgcctgattacgaccaacttgtttcatcagagcgatacagatgaaatcttagaatatttgtacttgattcaatatcggcgttaacatatcaagcaggtggattgaaaggcgcacttcgttcgggaaagggcagcttagtcttgataagtgcttttttagatgcaaactcgatcgacgacaatattgtgtgatcagtcgcatctagcaactaaacgacacgaatgtgtgatggacgacagcgaaatagttacgatgacacgaatgtgttatcgatgacaaataatatgttactcgacaactttgaaagaatcgggatgagaggattcgaacctccggccccttcgtcccgaacgaagtgcgctaccaagctgcgctacatcccgtagttatcagatactaaattagcatagaggcgcgatcgctgttcattgcctttgaaaattgaaaaccgtt

SEQ ID NO: 1270 - DNA, 1866 bp, Scytonema hofmanni
atggccgacgaggaattcgagttcaccgaggaactgacccaggtgccagatgccatcctgctggacaagagcaacttcgtggtggaccccagccagatcatcctggaaaccagcgacagacagaagctgaccttcaacctgatccagtggctggccgagtctcccaacagaaccatcaagagccagcggaagcaggccattgccgatacactgggcgtgtccaccagacaggtggaaagactgctgaagcagtacgacgaggaccggctgacagagacagccggaattgagagagccgacaagggcaagtaccgggtgtccgagtactggcaggacttcatcaagaccatctaccagaagtccctgaaggacaagcaccctatcagccctgcctctgtcgtgcgggaagtgaagagacacgccatcgtggacctgaagctgaagcctggcgacttccctcaccaagccaccgtgtacagaatcctgacacctctgatcgagcagcacaagagaaagaccagagtgcggaatcctggcagcggcagctggatgacagtggtcacaagagatggccagctgctgaaggccgacttcagcaaccagatcattcagtgcgaccacaccaagctggacatccggatcgtggacatccacggcagcctgctgtctgattgtccttggctgaccaccattgtggacacctacagcagctgcgtcgtgggcttcagactgtggatcaagcagcctggcagcaccgaagttgccctggctctgagacatgccattctgcccaagaactaccccgacgactacaagctgaacaaagtgtgggagatcagcggccctccattccagtactttttcaccgacggcggcaaggacttcagaagcaagcacctgaaggccatcggcaagaaactgggcttccagtgcgagctgagagacagacctcctgaaggcggcatcgtggaacggatctttaagaccatcaacacccaggtcctgaaggatctgcctggctacacaggcgccaacgtgcaagaaagacccgagaacgccgagaaagaggcctgcctgacaatccaggatctggataggatcctggccagcttcttctgcgacatctacaaccacgagccgtatcctaaagagccccgggacaccagattcgagcggtggtttaaaggcatgggcggcaagctgcctgaggctctggatgagagagagctggatatctgcctgatgaaggaagctcagagagtcattcaggcccacggctccatccagttcgagaacctgatctacagaggcgagtctctgaaggcctaccggggcgagtatgtgaccctgagatacgaccccgaccacattctgaccctgtacgtgtacagctgcgaaaccgacgacaacgtggaaaacttcctggactacgcccacgccgtgaacatggacacacacgatctgagcgtggaagaactgaaggccctgaacaaggatcggagcaaggcccggaaagagcacttcaactacgacgccctgctggccctgggcaagagaaaagaactggtggaagagaggaaagaggacaagaaagagaagcggcggagcgagcagaagagactgagaggcgccagcaagaaaagcagcaacgtgatcgagctgcggaagtccagagccagcaccagcctgaagaaggacgaccaccaagaggtgctgcccgagaaagtgtgcaccgaagagatcaagatcgagaagattgagccccagcctcaagagaacatcagcgcccagatcgacacccaagaggaacacaggcacaagctggtggtgtccaaccggcagaagaacctgaagaaaatctggtga

SEQ ID NO: 1271 - DNA, 855 bp, Scytonema hofmanni
atggccagatctcagctggccacacagagcttcgtggaagtgctggctcctcagctggatctgaaggcccagatcgccaagaccatcgacatcgaggaactgttccggacctgcttcatcaccaccgacagagccagcgagtgcttcaagtggctggacgagctgcggatcatgaagcagtgcggcagagtgatcggccccagagatgtgggcaaaagcagagctgccctgcactaccgcgacgaggacaagaaaagggtgtcctacgtgaaggcttggagcgccagcagcttcaagagactgttcagccagatcctgaaggacatcaaccacgccgctcctaccggcaagagacaggatctgaggcctagactcggcggcagcctggaactgtttggactggaactggtcatcatcgacaacgccgagaacctgcagaaagaggccctgatcgacctgaagcagctgttcgaggaatgccacgtgccaatcgtgctcgtcggcggaaaagagctggacgatatcctgcagggctgcgacctgctgaccaactttcccacactgtacgagttcgagcggctggaacaagaggacttcagaaagaccctgagcaccatcgagttcgacatcctgagcctgcctgaggcctctaatctcggcgagggcaacatcttcgagatcctggccgtgtccaccaacgccagaatgggcgtgctggtcaagatcctgacaaaggccgtgctgcacagcctgaagaacggcttcagcagagtggacgagagcatcctggaaaagatcgccagcagatacggccggaaatacgtgcccctggaaagccggaaccggaacgaatga

SEQ ID NO: 1272 - DNA, 567 bp, Scytonema hofmanni
atgctggtggtcatggccgagaacacattccccagcaaggtggaaatcggcatgaacgaggacgacgagatcctgcctaagctgggctacgtggaaccttacgagggcgagagcatcagccactacctgggcagactgcggagattcaaggccaacagcctgcctagcggctacagcctgggaaagattgctggactgggcgccgtgatcagcagatgggagaagctgtacttcaacccgtttcctacacagcaagagctggaagccctggcctctgttgtgggagtgaacgccgatagactgagccagatgctgcctcctaagggcgtgaccatgaagcccagacctatcagactgtgcggcgcctgctaccaagagagcccctttcacagaatcgagtggcagttcaaggacgtgatggtctgcgaccggcaccagctgagactgctgaccaagtgcaccaactgcgagacaccctttcctatacctggcgactgggtgctgggagagtgccctcactgctttctgccttttgccaccatggccaagaagcagaagaagggctga

SEQ ID NO: 1273 - DNA, 1446 bp, Scytonema hofmanni
atgaacggctacatctacagcaacgacgacgacatcaagaaaaaagtgatcctcgtgtggcagatctacttcctgaagcagctgatcgagagcggcacctacagcttcatcaagtacctgtacttccccaacgagtgcctgctgaagatcaagaacatcattcttgtctggcaaatctattttctcaaacagctcatcgagtccggcagctactcttttatcaagtatctctactttccgaatgagtgtctccccaagattaagaatatcatactcgtttggcagattggctttctgaagcaactcattgagtctggcctgtactcctttattaagtacctttatttccagcgcggctggctgcccaagagggatgtgaattggctgaacctgaagaacaagcccggcaggatcttcgtgaagttcaacggcctgaagaagaacattatcaaccccgagttctacatctgctgcggcagccggcagcggaactacttccagagattctgccaggactggcaagtgtggcacgacaacgaggaaacctacagcagcggcctgttcttcctgagaagcgccagactgctgtggcaagagcggaaaggcattggcgccccttggaaagtgaaccggctgatcctgcagtgcagcatcgagacaagactgtggaccgaggaagagacagaactcgtccggaccgagaagatcgtgaaaaccgagaaaaccatccggaagatggaacaagagcgggatctgacccagaaacagctgacccatctgcagagagagcggacccagaggcagaagctgaacaacccatttccaggcagacccagccagcctctgtaccagggcaagagcaatatcatcgtgggcgtgtccttcggcctggacaaacctgctacagtggccgtggtggatgccgccaacaacaaggtgctggcctacagaagcaccaaacagctgctgggaaagaactacaacctgctgaaccggcagagacagcagcagcagagactgagccacgagagacacaaggcccagaagcagttcgccctgaacgatttcggcgagtctgagctgggccagtacgtggacagactgctcgccaaagagatcattgccattgccaagacctacaaggccggcagcatcgtgatccccaagctgagagacatgagagagcagatcagcagcgagatccagagcagagccgagaagaagtgccccggctacaaagaggcccagcagaagtacgccaaagaataccggatgagcatccacagatggtcctacggccggctgattgagagcatcaaaagccaggccgccaaggccggaatcagcacagagattggcacccaccagatcagaggcagccctgaggaaaaggccagagatctggccgtgttcgcctaccaagaaagacgggccgctctggtgtaa

SEQ ID NO: 1274 - DNA, 492 bp, Scytonema hofmanni
ttcactaatctgaaccttgaaaatataatatggatataacagcgccgcagttcatgctctttggagccgctgtactgtgaaaaatctgggttagtttttggcggttgtcagaccgtcatgctttctgaccctggtagctgcccgcttctgatgctgctgtcgcaagacaggataggtgcgctcccagcaataaggagtaaggcttttagccatagtcgttatttataacggtgtggattaccacagtggtggctactgaatcacccccttcgtcggtcgggggaaccctctcaaatatttttttggcgtgtcaaagcgggggcaaaatccctggagtcccgccaaaactttaaaacccttatccagtcttgacttaagaaactagtatgtcaatgcatttagttttttaattttcagttcgagactttttaagcagacctgccaaattatgtgtatggaaagcttttatagcaagggttctagacgggtcga

SEQ ID NO: 1275 - DNA, 37 bp, Scytonema hofmanni; identical to SEQ ID NO: 819

SEQ ID NO: 1276 - DNA, 544 bp, Scytonema hofmanni
  misc_feature (521)..(544): n is a, c, g, or t
ttcactaatctgaaccttgaaaatataatatggatataacagcgccgcagttcatgctctttggagccgctgtactgtgaaaaatctgggttagtttttggcggttgtcagaccgtcatgctttctgaccctggtagctgcccgcttctgatgctgctgtcgcaagacaggataggtgcgctcccagcaataaggagtaaggcttttagccatagtcgttatttataacggtgtggattaccacagtggtggctactgaatcacccccttcgtcggtcgggggaaccctctcaaatatttttttggcgtgtcaaagcgggggcaaaatccctggagtcccgccaaaactttaaaacccttatccagtcttgacttaagaaactagtatgtcaatgcatttagttttttaattttcagttcgagactttttaagcagacctgccaaattatgtgtatggaaagcttttatagcaagggttctagacgggtcgagaaatcccggctaggggtgggttgaaagnnnnnnnnnnnnnnnnnnnnnnnn

SEQ ID NO: 1277 - DNA, 500 bp, Scytonema hofmanni
tttaatgaaagtcacgaaaatacgtaacttatgtcccacgaattcggaaaattggacattaattctttaaaactgacaataattatttaaattatgtacattcgcaaattatatgtcgcgattcgcaaattagtgtcgcaactgctttaaagcctggaagctatattgtgtaagtatcataagctatttaccccagaaaagaccaataaacttaattcgcatattgtatgtcgcaaagtccaatttcgcatattatatgtcgtttgttaagaattaggtctttcgcaaattagatgtcggattttgtcataattaatggtacattagtacgttaattattcatgagtgggtttcactctaatggcagacgaagaatttgaattcactgaagaattgacacaagttccagacgctattttgcttgacaagagtaattttgtggtagacccatcgcaaattattctagaaacttcggataggcaaaaactgacatttaatct

SEQ ID NO: 1278 - DNA, 500 bp, Scytonema hofmanni
gctaggagtgtattaataatagaagattcaaatctttcaaatttttctgagagggttgaaaggagcgctacaatggcatcattgatttcagaactttagaataattgaacactacgagcttaaataataatgctttcttttcgacgacattattttgttaacgtttactatgtttgtttagacgacactaatttgttaataacgacattaatctgttattcgacatctagctattagggcgacaaataatttgtcgctctatgacttgagatcaagacagtctgcgacattaatttgcgaaaagttagtgtaattaaattacctacataaaaaccaccaaagcgacattaatgtgccaatcgcgacactaatttgcgaattgcgacatataatttgcgaatttacaacaatggaggtaagcgggttcgaaccgctgacctctgcaatgccattgcagcgctctaccaactgagctatacccccttgtcatgcgtttctga

SEQ ID NO: 1279 - DNA, 1899 bp, Nostoc species
atgagcaccagaagcctgtctcagggcgccaatctgcctggacacgaagaagtgctggccacagagcaaggcggcgaacaggtggaaggcaagagctacctgctgttcaacgacgacagccccgagttccagcagaaagtggacgtgatcgacgccatcgtgcaggcccctgacaagaacgccagaagagaggccattgccgaggccgctaaagccctgggcaagtccaccagaaccatcaagcggatgatcgagcgggtgcagaaagacggcgttgccacacttgctgtgggcagacaggataagggccagttcagaatcagcgagcagtggttcaagttcatcgtggacacccacaaatggggccagaccaagggcagcagaatcaaccacaaccagatccacgtgcagctgatctccctggccagcaagggcgaagatctgcggagcaagaaatacgtcgagaagttcaagcagtaccccgaggtgctggaagatctgatcgagggcaagttccccagccacgtgaccgtgtacaaagtgatcaacttctacatcgagcaagagaaccggatcgtgcggcaccctggatctccaagagagggccagatcatccagaccaccgagggcatcctggaaatcagccacagcaatcagatctggcaggtcgaccacaccaagctggacatcctgctgatcgacgatgaggacaaagagatcatcggcagaccctacatcaccctggtcatggacagctacagcggctgcgtcgtgggcttttacctgggctatgagtctgccggctctcacgaagtggccctggccttcagacacagcatcctgcctaagcactacgagcccgagtacgagctgcaagagaagtgggacatcttcggcgtgccagagtacctggtcaccgacagagccaaagagttcaagagcgcccacctgaagcagatcagcctgcagctgggcttccagcggagactgagagcctttccttctgccggcggactgatcgaaaccatcttcgacaagatcaacaaagaggtgctgagcttcttcggcggctacacaggcagctctgtggaagaaagacccaagaatgccgagaaaaccgcctgtctgaccctggaccagctggaaaagatcctcgtgcggtacttcgtggaccactacaaccagcacgactaccccaaagtgaagcagctgaagcggatcgagagatggaagtccatgctgctggtggaacccgaggtgttcgacgagagagagctggatatctgcctgatgaaggccacctaccggaacgttgagaagtacggcagcgtgaactttggcggcctggtgtaccagggcgatagcctcgttggatacgagggacagaagatctctctgagatacgaccagcggaacatcctgacactgctggcctacaccagacctagcaatgcccagcctggcgagtttatcggcgtggtcaaagcccgcgacctggaaaaagagagactgagcctgggcgagctgaactggatcaagaagaagctgcgcgagaaggccaaagaagtggacaacagctccatcctgaacgagcggctgaagatcgtggaagaggtcgaggaaggcagaaagagccggcggaagagacagaggaaggcccaagaaaagcacgcccacgagagcaacaagagcaaagtgctggaaatgttccccgagaacgccacactggaagaaaccgccatcacacaagagaacttccccagcgctcctaccaccagccagaacgtggtcaagagcatcaacaagcaggatatccccgaggccaaccggaccgccaaaacaagacgacctagagtgggagtgcaggactggaaccagttcgtgaaggacaactggtga

SEQ ID NO: 1280 - DNA, 921 bp, Nostoc species
atgagcgagacaaatctggcccacgtgcagcccaagctgcagaagcagtttgacgcctctctgcagtccgccgaggaactgagaaggctgccagagattcaggccgaggtggaaagaatcggcaaggccgatacctacctgcctctggacagagacaccgagctgttcgactggctggacgatcagagggatgccaagctgtgtggctacgtgacaagcgccacaggctctggactgctgaaagcctgccagctgtaccggatgcagtacgtgaagagaagaggcaccctgctggaaatccccgccacagtgatctacgccgagatcgatcaacacggcggacccaccgatctgtactacagcatcctggaagaagtgggacaccctctgaccaatgtgggcgccctgagagatctgagagccagagcttggggaaccctgaaggcctacggcgtgaagatcctgatcgtgggcaacgccgactacctgacactggaaggcttcaacgagctggtggacatcttcaccaagcggcggatccccatcatcctcgtgggcacctactacctgagcgagaatatcctggaacggaagtccctgccttacgtgcgggtgcacgacagctttctggaaccctacgagttccccaacctgaccgaagaggacatcatcgaggtggtggacgactgggagcagaagttcctgacacaggacggccggctgaatctgacccagatggaaagcgtgatcagctacctgaagctgaagtctggcggcctgatcgagcccctgtacgacctgctgagaaagatcgccattctgaagctggacgagcccagcttcgagctgagccaggacaatctgaccagaaagttcggcagacggaaagagcccaaagtcaagttccagcggaagggctga

SEQ ID NO: 1281 - DNA, 513 bp, Nostoc species
atggaacctgaggccgtgcaacaccctccttggtacgtggaacctaacgagggcgagagcatcagccactacttcggcagattcagacggcacgaggccgtgtgtgttagctctcctggcacactgtctaaggccgctggaatcggacctgtgctggccagatgggagaagttccggttcaacccatttccgatccagaaagagctggaagccattgccaagctgatcggcctggacgtggacagaattgcccagatgctgcctcctaagggcgagaagatgaagatggaacccatcagactgtgcgccgcctgttatgccgagcagccttaccacagactggaatggcagttccagagcaccgtgggctgcgagagacacaagctgagactgctgagcgagtgccccttctgcaaagagagattcgctatccccgctctgtgggagaagggcgagtgcaagaaatgtcacgccctgttccggtccatggccaagagacagaaggcctactga

SEQ ID NO: 1282 - DNA, 2040 bp, Nostoc species
atgagcagcgaccggaagaagaaaagcacaatccccgtgcaccggaccatcagatgtcacctggatgccagcgaggacatcctgcggaaagtgtgggaagagatgacccagaagaacacccctctgatcctgaagctgctgaagtccgtgtccgagcagcctgagttcgaggccaacaaagagaagggcgagatcaccaagaaagagatcgtcaagctgcggaagaacgtgaccaagaatcccgagctggaagaacagagcggcagactgagaagcagcgccgagagcttcgtgaaagaggtgtacagcagctggctgaccctgtaccagaagcggaagcggcagaaagagggcaaagagtacttcctgaagaacatcctgaagtctgacgtcgagctgatcgacgagagcaactgcgacctggaaaccatccgcagcaaggcccaagaggtgctgtctcagcccgaggaattcatcaagcagctgaccatcaacgacgaggacgtgaagcctaccaagagcgcccggaagagagtgaacaagaacatcaacaacaagagcaccgacgccgagcagcggaaggatagcagcagcaccaacaacgtggacaagaacaagctggaaaccctgaccaacatcctgtacgagatccacaagcagacccaggacattctgaccagatgcaccgtggcctacctgatcaagaaccacaacaagatcagcaacctggaagaggatatccagaagctgaagaagcggcggaacgagaagatcgtgcagatcaagcggctggaaaaccagatccaggacaacagactgcccagcggcagagatatcaccggcgagagatacagcgaggccttcggcaatctgatcaatcaggtgcccaagaacaatcaagagtgggaagattggatcgccaacctgagcaagaagatcagccatctgccttatcctatcgactacctgtacggcgacctgagctggtacaagaacgacgtgggcaacatcttcgtgtacttcaacggctggagcgagtaccacttcaagatctgctgcaacaagagacagcggcacttcttcgagcggtttctcgaggactacaaggccttcaaggtgtcccagaaaggcgaggaaaagctgagcggctccctgatcacactgagatccgctcaactgctgtggcaacaaggcgaaggcaagggcgagccttggaaggtgcacaaactggccctgcactgcacctacgacagcagactgtggacagccgagggaacagaggaagtgcgcaaagagaaaaccgacaaggcccagaaacgggtgtccaaggccgaagagaatgagaagctggacgacatccagcagacacagctgaacaaggacaagtccagcctgagccggctgaagaatagcttcaacagacccggcaagctgatctaccagagccagtccaacatcatcgtgggcatcagctttcaccccatcgagctggccacagtggctatcgtggacatcaataccaaaaaggtgctggcctgcaacaccgtgaaacagctgctgggcaacgccttccatctgctgtctagacggcggagacagcaggtccacctgtccaaagagagaaagaaggctcagaagaaggacagcccctgcaacatcggcgagtctaagctgggcgagtatatcgacaagctgctggccaagcggatcgtggaaatcgccaagttttaccaggccggctgcatcatcctgcctcggctgaaggacatgaaggaaatccggaccagcgccatccaggccaaagccgaggccaaaattcctggcgacgtgaacgctcagaaactgtatgtgaaagagtacaaccggcagattcacaactggtcctacaacaggctgcaagagagcatcaagagcaaggccgccgagtttaagatctccatcgagttcggcatccagcctcactacggcacccttgaggaacaggccaaggacctggccttctacgcctaccagtccagaaatcacaccctgggcagatga

SEQ ID NO: 1283 - DNA, 674 bp, Nostoc species
aatttctacccgaagaatataatcttattgaaattaaatcggtgccgtcatacatgctcttttgagccttaactgtatgatgctacagtattaacccctttgtgtagatactgtggaatgggttagtttaacgcttggaaaagcgtattctttctgaccctggtagctgccaactctacctgtgcgatcatctaagcgtttgttagtggtaattgcttgggtaaggtaatactgctgttagatgagaaagtactcgcaccgagacgcatgggaagtataaggtgttagggttccaaacagcccagaaccttagctcttgacatcaaactcttttagcttggtgttaggtgccagagcggcctgtactactgaaatcttagattttggttttatgaggaggatcattacctcttactttacaacaaagtaagggtacgggtataccgtcacggtggctaccgaactaccaccccctaatttttatttttggcagctcaaagcgggggcaaaatccctggggcgctgccaaatgtccaaaaatcttgtctgcattgggtattactgttttagtcatgaataaaattttattcattggctgtaaaaaataggaattaaaggaggcttgtcaattttgccttcagaagcccttgttggcaagagttttcacgggtgcg

SEQ ID NO: 1284 - DNA, 37 bp, Nostoc species; identical to SEQ ID NO: 825

SEQ ID NO: 1285 - DNA, 726 bp, Nostoc species
  misc_feature (703)..(726): n is a, c, g, or t
aatttctacccgaagaatataatcttattgaaattaaatcggtgccgtcatacatgctcttttgagccttaactgtatgatgctacagtattaacccctttgtgtagatactgtggaatgggttagtttaacgcttggaaaagcgtattctttctgaccctggtagctgccaactctacctgtgcgatcatctaagcgtttgttagtggtaattgcttgggtaaggtaatactgctgttagatgagaaagtactcgcaccgagacgcatgggaagtataaggtgttagggttccaaacagcccagaaccttagctcttgacatcaaactcttttagcttggtgttaggtgccagagcggcctgtactactgaaatcttagattttggttttatgaggaggatcattacctcttactttacaacaaagtaagggtacgggtataccgtcacggtggctaccgaactaccaccccctaatttttatttttggcagctcaaagcgggggcaaaatccctggggcgctgccaaatgtccaaaaatcttgtctgcattgggtattactgttttagtcatgaataaaattttattcattggctgtaaaaaataggaattaaaggaggcttgtcaattttgccttcagaagcccttgttggcaagagttttcacgggtgcggaaatctcgttaggtggtgggttgaaagnnnnnnnnnnnnnnnnnnnnnnnn

SEQ ID NO: 1286 - DNA, 500 bp, Nostoc species; identical to SEQ ID NO: 826

SEQ ID NO: 1287 - DNA, 1000 bp, Nostoc species; identical to SEQ ID NO: 827

SEQ ID NO: 1288 - DNA, 1746 bp, Tolypothrix campylonemoides
atgcaggatacccacagcagcaagacccctgccaacagcaatagcaccctgaccgagacaaacgtgatcgtgtccgagctgagcgacgaggccaagctgaagatggaagtgatccagagcctgctggaagccggcgacagaacaacatacgcccagagactgaaagaggccgccgagaagctgggaaagtctgtgcggacagtgcggcggctgatcgacaagtgggagaaagagggactgatcggcctgacacagaccgagagaaatgacaagggcaagcacagagtggacgagaactggcaagagttcatcctcaagacctacaaagagggcaacaagggcagcaagcggatgaccagacagcaggtcgccgtcagagtgaaggccagagctgatgagctgggcgtgaagcctcctagccacatgaccgtgtacagagtgctgaagcccctgattgacaaagaggaaaaggccaagagcatcagaagccccggctggcgaggaagcagactgagcgtcaagaccagagatggcaaggatctgcaggtcgagtacagcaatcaagtgtggcagtgcgaccacaccagagtggatgtgctgctggtggatcagcacggcgagattcttggcagaccttggctgaccaccgtgatcgacagctacagcagatgcatcatcggcatcaacctgggctacgacgcccctagctctcagattgtggctctggccctgagacacgccatcctgcctaagagctacggcagcgagtatggcctgcacgaggaatggggcacatacggactgcccgagcacttctataccgacggcggcaaggacttcagaagcaaccatctgcagcagatcggcgtgcacctgggcttcgtgtgtcacctgagagtgtctaaggcccctccattcgctcagagactgcggagaaggcaagaggccagaccttctgaaggcggcatcgtggaaagacccttcaagaccttcaacaccgagctgttcagcaccctgcctggctacacaggcagcaacgtgcaagagaggcctcaagaggccgagaaagaagcctgtctgaccctgaggcagctggaacagcagctcgtgcggtacatcgtgaaccactacaaccagcggctggacgccagaatgggcgatcagaccagatttcagagatgggagagcggcctgatcgccacactggatctgctcagcgagagagatctggacatctgctttatgaagcaaacccgcagacagatccagagaggcggctacctgcagttcgagaacctgatgtaccggggcgagtacctggctggatatgccggcgaatctgtggtgctgagatacgaccccagagacatcaccaccatcctggtgtaccggaaagaaggcgacaaagaagtctttctggccagggcctacgctcaggacctggaaacagagcagctgagcatcgatgaggccaaggccagctctagacaagtgcggaaggccggcaagaccgtgtccaacagatctatcctggccgagatcagagagcgggaaacctttagcacccagaaaaagaccaagaaagagcggcagaagatcgagcaggccgaggtgcagaaagccaagcagcccatcagagtggaacccgaggaacaggtggaagtggccagcattgatgcccagaccgagcctgagatgcccgaggtgttcgactacgagcagatgagagaagattacggctggtga

SEQ ID NO: 1289 - DNA, 837 bp, Tolypothrix campylonemoides
atgaccacacaagaggcccaggctgttgctcagcagctgggagagatccccgtgaacgatgagaagctgcagaaagagatccagcggctgaaccggaagggcttcgttcctctggaacaggtgcagatcctgcacgactggctggaaggcaagagacagagcagacagtccggcagagttgtgggcgagagcagaaccggcaagaccatgggctgtgacgcctaccggctgagaaacaagcctaagcaagaggccggcaagcctcctacagtgcccgtggcctatatccagattcctcaagagtgcggcgccaaagaactgttcagcgtgatcctggaacacctgaagtaccaagtgatcaagggcaccgtggccgagatcagagacagaaccctgagagtgctgaaaggctgcggcgtggaaatgctgatcatcgacgaggccgaccggttcaagcccaagacctttgctgaagtgcgggacatcttcgacaagctggaaatctccgtgatcctcgtgggcaccgacagactggatgccgtgatcaagagggacgaacaggtgtacaaccggttccggggctgccacagatttggcaaactgagcggcgaggacttcaagcggaccgtggaaatctgggagaagaaggtgctgcagctgagcgtggccagcaacctgagcagcaagacaatgctgaaaaccctgggcgaagccaccagcggctatatcggactgctggacatgatcctgagagagagcgccatcagagccctgaagaaaggcctgcagaaggtggacctggaaaccctgaaagaagtggccgccgagtacaagtga

SEQ ID NO: 1290 - DNA, 528 bp, Tolypothrix campylonemoides
atggaagtgaccgagatccagagctggctgttcagagtggaacccctggaaggcgagagcctgtctcacttcctgggcagattcagacgggccaacgatctgacaccaaccggcctgggaaaagccgctggacttggcggagctattgcttatggcggagccctgcctatcgccagatgggagaagttccggttcaaccctccacctagccggcagcaactggaagccctggctacagtcgtgggagtcgatgccgatagactggaacagatgctgcctcctaccgaagtgggcatgaagatcgagcccatcagactgtgcggcgcctgttatgcccagtctccttgccacaagatcgagtggcagttcaaagtgacccaagagtgcgccagccacaagctgagactgctgagcgagtgccctaattgcggcgccagattcaaagtgcccgctctgtgggttgacggctggtgccagagaagcttcctgaccttcgtggaaatgacccgctaccagaaaagcgtgtga

SEQ ID NO: 1291 - DNA, 1650 bp, Tolypothrix campylonemoides
atgaagcggagccagtaccagctggaaggcaagaccagatggctggaaatgctgagaagcgacgccgagctgctggaagctagcggagttgctctggacagcctgcggatcaaggccaacgaaattctggcccagttcagccctcagagcgcccctgttgaggccaagcagaagaagggcaagaccggcaagaaaaccagaaagagccagaacagcgacaacaatcggagcctgagcgccacactgttccaggcctacagagacaccgaggacaacctgaccagatgcgccatcagctacctgctgaagaacggctgcaaggtgtccgacaaagaagaggaccccgagaagttcgcccagcggagaagaaagatcgagatccagatcgagcggaagagagagcagctcgaggccaggattcccaagggcagagatctgaccgataccacctggctcgaaaccctgttcctggccacacaccaggtgccaaacaatgaggcccaggccaagagctggcagaacagcctgctgagacagagcagcagcgtgccatttcctgtggcctacgagactaactccgacatgacctggttcaagaaccacaaaggccggatctgcgtgaagttcaacggcctgagcgagcacaccttcgaggtgtactgcgaccagagatacctgcactggttccagcggtttctggaagatcagcagatcaagcacgagagcaagaaccagcacagcagcagcctgttcaccctgagatctggcagaatcgcctggcttgaaggcgaggacaagggcgttagaggatctgctgctgcaggcgccccttggaacatccacagactgagcctgtactgctgcgtggacaccagactgtggaccgatgagggcacagaactcgtgcggcaagagaaggccgaggaaatcgccaagaccatcaccaagaccaaagagaagggcgacctgaacgagaagcagctggcccacatcaagcggaagaacagcaccctggccagaatcaacaacccatttccacggcctagcaagcccctgcacaagggacagtctcatgtgctcgtgggagtgtctctgggcctcgagaaacctgctacagtggccgtggtggatgccacaacaggcaaggtgctgacctaccggtccatcaaacagctgctgggcgacaactacaagctgctgaaccggcagcagaagcagaaacacagcctgagccacaagcggcagatcgcccaaacactggccgctcctaatagattcggcgagagcgagctgggccagtacgttgacagactgctggccaaagaaatcgtggctatcgcccaggcctatagcgccggatctatcgtggtgcctaagctgggagacatgcgcgagcaagtgaactctgagattcaggccaaggccgagcagaaatgccccgagtgtctggaagcccagaagaactacgccaagcagtaccggcacagcgtgcaccagtggtcttacggcagactgatcagcagcatctgcagctctgctgcccaggccggaatcgtgatcgaagagggaaagcagcccatcagaggcagccctcacaacaaagccaaagaactggccattgccgcctaccacagcagaaagaacagctga

SEQ ID NO: 1292 - DNA, 462 bp, Tolypothrix campylonemoides
tacacaaactttcttccgaaccttgaaaataaaataagtaatcaacagcgccgttgttcatgcgtaaatacgcctctgaacaatgataaatgtgggttagtttgactgttgtcaaacagtcttgctttctgaccctggtagctgcccaccttgaagctgctatcccttatggataggaatcaggtgcgcccccagtaatagaggtgcgggtttaccgcagtggcggctactgaatcacctccgagcaaggaggaacccaccttaattattttttggcaagccaaagcgggagcgattttaccgggagccatgccaaagttttaaatctcttgtttagcgagatttctagcctttgaagtttcagttgatttacttttttaagtgttgactgacaggcgattttggcagccttgacaaaaatgcctccggaaattttgacaaatcaggggtttgaagcgcaca

SEQ ID NO: 1293 - DNA, 37 bp, Tolypothrix campylonemoides; identical to SEQ ID NO: 1059

SEQ ID NO: 1294 - DNA, 514 bp, Tolypothrix campylonemoides
  misc_feature (491)..(514): n is a, c, g, or t
tacacaaactttcttccgaaccttgaaaataaaataagtaatcaacagcgccgttgttcatgcgtaaatacgcctctgaacaatgataaatgtgggttagtttgactgttgtcaaacagtcttgctttctgaccctggtagctgcccaccttgaagctgctatcccttatggataggaatcaggtgcgcccccagtaatagaggtgcgggtttaccgcagtggcggctactgaatcacctccgagcaaggaggaacccaccttaattattttttggcaagccaaagcgggagcgattttaccgggagccatgccaaagttttaaatctcttgtttagcgagatttctagcctttgaagtttcagttgatttacttttttaagtgttgactgacaggcgattttggcagccttgacaaaaatgcctccggaaattttgacaaatcaggggtttgaagcgcacagaaatcctagcttgaggcgggttgaaagnnnnnnnnnnnnnnnnnnnnnnnn

SEQ ID NO: 1295 - DNA, 500 bp, Tolypothrix campylonemoides
gaattagagtaaatcgtcaagactacttaagcaagttcacaacctaattaaccaaaaactatacgtaggatatccatctgatacctaaaaactacaattttgaagtatcatatgccctcaaaagtttaatttttagtgtacattcactaattatttgtcaatttaacaaaatattgtcaaaatacgtgtaaatgactgaaaccctgctgtaacaaagcttatggcaggtttttaattattaaacttctcacaaccaccgttaaacgcgattcacaaattagatgtctaatccctgaaatttaacaatttaagtgtcactttccagaaacaaggaaaattactaagttttagaaaacttaacagattaaatgtcactctggataggtagaatagacatatatgttgcaattaaacaaatgtgtatatgcaggacactcattcttctaaaacacctgcaaactcaaatagcactctcaccgaaacaaatgtcattgtgtcgg

SEQ ID NO: 1296 - DNA, 500 bp, Tolypothrix campylonemoides
gttacaacaaccctcccggataggggcgggttaaaagagcattactatgttccgcaagctaggctcaaaattccaatatattctttaaatataggtgggttgaaagaggtcacgagttcaatcttcttcgttgaaagtagaattataaaatgaactcagcaatgttgacatttaattcgttaaaactagaaaactagtaattatttgtcgataactgtgcaagccaggtgaagtgacaattattctgttaacagtgacattaactgtttaaaagtgacatcaatctgttaacagtgacaaataattagttagggcttgctgaaaaagaaagaaaaggcagcattctatgatttttagagcagagatatgtattcaagtgcaagaaaaaaggctataatactctgaaacccttgcatcaccgtaagctcctggtatacttagtagcttaagtaacgatgtaccgaaaaaaggaaccaactcaaattccaccggaaagcttt

SEQ ID NO: 1297 - DNA, 1884 bp, Aphanizomenon flos-aquae
atgagcggctttcacagcatggccgacgaggaattcgagttcaccgaggacagcacccaggtgccagaagccatcctgctggacaagagcaacttcgtggtggaccccagccagatcatcctggccacaagcgacagacacaagctgaccttcaacctgatccagtggctggccgagtctcccaacagaaccatcaagagccagcggaagcaggccgtggccaacacactggatgtgtccaccagacaggtggaacggctgctgaagcagtacgacgaggacaagctgagagagacagccggcatcgagagagccgacaagggcaagtacagagtgaacgagtactggcagaacttcatcaagaccatctacgagaagtccctgaaggacaagcaccctatcagccccgccagcatcatcagagaagtgaagagacacgccatcgtggacctgggcctgaagctgggagattatccacaccaggccaccgtgtaccggatcctggatcctctgatcgagcagcacaagagaaagaccagagtgcggaatcctggcagcggcagctggatgacagtggtcacaagaaagggcgagctgctcaaggccgacttcagcaaccagatcattcagtgcgaccacaccaagctggacgtgcggatcgtggacaaccacggcaatctgctgagcgagaggccttggctgaccaccattgtggacaccttctccagctgcgtcgtgggcttcagactgtggatcaagcagcctggctctaccgaagtggccctggccttcagacatgccattctgcccaagaactaccccgaggactaccagctgaacaagagctgggatgtgtgcggacacccctaccagtactttttcaccgacggcggcaaggacttcaacagcaagcacatcaaggccatcggcaagaaactgggcttccagtgcgagctgagggacagacctcctgaaggcggcatcgtggaacggatctttaagaccatcaacacccaggtcctgaaggatctgcctggctacacaggcgccaacgtgcaagaaagacccgagaacgccgagaaagaggcctgcctgacaattcaggatctggataagatcctggcctccttcttctgcgacatctacaaccacgagccgtatcctaaagagccccgggacaccagattcgagcggtggtttaaaggcatgggcggcaagctgcctgagcctctggatgagagagagctggacatcttcctgatgaaggaagctcagagagtcgtccaggctcacggctccatccagttcgagaacctgatctaccggggcgagttcctgaagtcccacaagggcgagtatgtgaccctgagatacgaccccgaccacatcctgagcctgtacatctacagcggcgagacagacgacaataccgaagagttcctgggctacgcccacgccatcaacatggacacacacgacctgagcatcgaggaactgaaggccctgaacaaagagcggagcaacgcccggaaagagcactgcaattacgacgccctgctggccctgggcaagagaaaagaactggtggaagaacgcaaagaggacaagaaggccaagcggaacagcgagcagaagagactgagaagcgccagcaaaaaggacagcaacgtgatcgagctgcggaagatcagagccagcaagagcagcaagaaacaagagaatcaagaggtgctgcccgagcggatcagccgggaagagatcaagatcgagaagattgagcagcagccccaagaaaacctgagcacaagccccaatcctcaagaggaagaacggcacaagctggtgttcagcaacagacggaagaacctcaacaagatctggtga

SEQ ID NO: 1298 - DNA, 852 bp, Aphanizomenon flos-aquae
atggctcagcctcagctggccacacagagcatcgtggaagtgctggcccctcggctggatatcaaagcccagatcgccaagaccatcgacatcgaggaaatcttccgggcctgcttcatcaccaccgacagagccagcgagtgcttcagatggctggacgagctgcggatcctgaagcagtgcggcagaatcatcggccccagaaacgtgggcaagagcagagctgccctgcactacagagatgaggacaagaaacgggtgtcctacgtgaaggcttggagcgccagcagcagcaagagactgttcagccagattctgaagaacatcaaccacgccgctcctaccggcaagacccaggatcttagacctagactggccggcagcctggaactgttcggactggaactggtcatcatcgacaacgccgagaacctgcagaaagaggccctgctggacctcaagcagctgttcgaggaatgcaacgtgcccatcgttctggctggcggcaaagagctggacgaacttctgcaggactgcgacctgctgaccaactttcccacactgtacgagttcgagcagctggaatacgacgacttcaagaaaaccctgaccaccatcgagctggacatcctgtctctgcccgaggcctctaatctggccgagggcaacatcttcgagatcctggccttcagcaccaacgccagaatgggcatcctgatcaagatcctgaccaaggccgtgctgcacagcctgaagaacggcttccacagagtggacgagtccatcctggaaaagatcgccagcagatacgggaccaagtacatccctctggaaaaccggaaccgggactga

SEQ ID NO: 1299 - DNA, 567 bp, Aphanizomenon flos-aquae
atgctggtggttatggcccagaacatcttcctgagcaagaccgagatcggcatcgacgaggacgacgagatcagacccaagctgggctacgtggaaccttacgagggcgagagcatcagccactacctgggcagactgcggagattcaaggccaacagcctgcctagcggctacagcctgggaaagattgctggactgggcgccatgatcagcagatgggagaagctgtacttcaacccgtttcctacacctcaagagctggaagccctgtctagcgccgtgggagtgaatgtggaccggctgatggaaatgctgcccagccagggcatgaccatgaagcccagacctatcagactgtgcgccgcctgttatgccgagtctccttgccacagagtggaatggcagctgaaggaccggatgaagtgcgaccggcacaacctgcggtttctgatcaagtgcaccaactgcgagacaccctttcctatacctgccgactgggtcaagggcgagtgccctcactgctttctgagcttcaccaagatggccaagcggcagaagcgggactaa

SEQ ID NO: 1300 - DNA, 1929 bp, Aphanizomenon flos-aquae
atgagcgtgatcaccatccagtgcagactggtggccgaagaggacagcctgagacagctgtgggagctgatgaccgagaagaacacccctttcatcaacgagatcctgctgcacctgggcaagcaccccgagtttgagacatggctggaaaagggcagaatccccgccgagagcctgaaaaccctgggcaactccctgaaaacacaagagcccttcacaggccagcctggcagattctacacaagcgctatcgccctggtggactacctgtacaagagttggttcgccctgcagaagcggcggaagaatcagatcgagggcaagcagcggtggctgaagatgctgaagtctgaccccgagctggaacaagagagccagagcagcctggaagtgatcaggaccaaggccaccgagctgttcagcaagttcacccctcagagcgatagcgaggccctgcggagaaaccagaacgacaagagcaagaagggcaaaaagaccaagaagcccacaaaggccaagaccagctccatcttcaagattctgctgaacacctacgaggaagccgaggatcccctgaccagatgtgccctggcctacctgctgaagaacaactgccagatcagcgagctggacgagaaccccgaggaattcacccggaacaagcggagaaaagagatcgagatcgagcggctgaaggaccagctgcagagcaggattcccaagggcagagatctgacaggcgagcagtggctcgaaaccctggaaatcgccaccgtgaaggtgccccagaacgagaatgaagccaaggcctggcaagccgctctgctgagaaagaccgccaacgtgccatttcctgtggcctacgagagcaacgaggacatgacctggctgaaaaacgataagaaccggctgttcgtgcggttcaacggcctgggaaagctgaacttcgagatctactgcgacaagcggcatctgcactacttccagcggtttctggaagatcaagagattctgcggagcagcaagcggcagcacagcagcagtctgttcacactgagaagcggcagaatcgcctggctgcctggcgaggaaaaaggcgagcactggaaagtgaaccagctcaacttctactgctccctggacacccggatgctgaccacagagggaacacagcaggtcgtggaagagaaagtgaccgccatcacagagatcctgaccaagaccaagcagaaggacgacctgaacgataagcagcaggccttcatcacccggcagcagagcacactgagccggatcaacaacccatttcctcggcctagcaagcccaactaccagggcaagagcagcatcctgatcggcgtgtccttcggactggaaaagcctgtgacagtggccgtggtggacgtggtcaagaatcaagtgatcgcctacagaagcgtgaaacagctgctgggcgagaactacaatctgctgaatcggcagagacagcagcaacagagactgagccacgagagacacaaggcccagaagcagaacgcccctaacagctttggcgagtctgagctgggccagtacgtggacagacttctggccgacgccatcattgccattgccaagaagtaccaggccggctccatcgtgctgcccaagctgagagatatgagagagcagatcagcagcgagatccagtccagagccgagaaccagtgtcctggctacaaagagggccagcagaagtacgccaaagaataccgcatcaacgtgcaccggtggtcctacggcagactgatcgagagcatcaagagccaggctgcccaggccggaatcgccattgaaactggcacccagcctatccgggcctctccacaagagaaggctagagatctggccctgttcgcctaccaagagagacaggccgctctgatctga

SEQ ID NO: 1301 - DNA, 484 bp, Aphanizomenon flos-aquae
tttactaatccgaaccttgaaaatataatatagatacaatagcgccgtagttcatgctccttggaatctctgtactatgaaaaatctggcttagtttggcagttggaagactgtcatgctttctgagcctggtagctgcccgcttctgatgctgctgtcgcaagacaggataggtgcgctcccagcaataaggagtaaggcttttagccctagtcgtttttataacgatgtggatttccacagtggtggctactgaatcacccccttcgtcgggggaatcctcccaaatctttttttggcaaaccataagcggggtcaaaaaccctgggaatctgccaaaaccttgaatcccttgtccagtattgatttgactcatttgaagagtgatgaatgtcctcaattgagagcaaaaaaacagattttttaacaggtttgccaaaatcgcatctggaaacctgtattggcaagggtctagacgggcgcg

SEQ ID NO: 1302 - DNA, 37 bp, Aphanizomenon flos-aquae; identical to SEQ ID NO: 813

SEQ ID NO: 1303 - DNA, 536 bp, Aphanizomenon flos-aquae
  misc_feature (513)..(536): n is a, c, g, or t
tttactaatccgaaccttgaaaatataatatagatacaatagcgccgtagttcatgctccttggaatctctgtactatgaaaaatctggcttagtttggcagttggaagactgtcatgctttctgagcctggtagctgcccgcttctgatgctgctgtcgcaagacaggataggtgcgctcccagcaataaggagtaaggcttttagccctagtcgtttttataacgatgtggatttccacagtggtggctactgaatcacccccttcgtcgggggaatcctcccaaatctttttttggcaaaccataagcggggtcaaaaaccctgggaatctgccaaaaccttgaatcccttgtccagtattgatttgactcatttgaagagtgatgaatgtcctcaattgagagcaaaaaaacagattttttaacaggtttgccaaaatcgcatctggaaacctgtattggcaagggtctagacgggcgcggaaatcccgactaggggtgggttgaaagnnnnnnnnnnnnnnnnnnnnnnnn

SEQ ID NO: 1304 - DNA, 500 bp, Aphanizomenon flos-aquae
cagcttttgctttacccctactacacatctgggttctttgtcatttggcaaaagtttaaatctcacccgtgtttagtatacatgtacattcgcaaattatatgtcgcatttcgcaagtcatgtcgcaactgcttttaagggctagaacctttattatataagcatcataagttatttacccctacaaaagacaaaattacctaattcgcatattgtatgtcgcaaaacctaatttcgcaaattaaacgtcggttgttaagattttggtattttgcaaattagatgtcgcatttttgagagattcatggtacattagtaccttaatcattcatgagtgggtttcactctatggcagacgaagaatttgaattcactgaagactcgacgcaagttccagaagctattttgcttgacaagagtaattttgtcgtagatccatcccaaattattctggcaacgtcggataggcataaactgacatttaatttaatccagtggct

SEQ ID NO: 1305 - DNA, 500 bp, Aphanizomenon flos-aquae
gtttcaactagcatcccgactaggggtggttaaaaatataggttattgacttgcgttaaccattaaaatggttgcaaaatagaaatgatcatgggagggttgaaaggagtgctgcgatcgaacacatattaataatcaaattaatgcccttgcagcaataatttattgtattgtgtagtcaatgttaagttcatgcgacattaatttgcgaaaacttagaataattaaattgactcagaaaaacaaccaccgcgacattaatttgcgaagaacgacattaatttgcgaactgcgacatataatgtgcgaatgtacacaaatggagaataggagactcgaacccctgacctctgcggtgcgatcgcagcactctaccaactgagctaattccccttagtcgtgcttaagtcaaaaactttagcacactatatatcttaacactcaggaaggacagatttcacatctttttccaaaaaaacttcctgtacctgctgcaaatc

SEQ ID NO: 1306 - DNA, 1731 bp, Calothrix species
atgacccacgcctctatcgccgacgtggaaaatggaaaggccgaggccaacatcatcgtgtccgagctgtctgatgaggccctgctgaagatggaagtgatccagacactgctgaaaaacagcgactgcagcaccagaggcgagctgctgaaacagtctgccgagaagctgggcaagagcgtgcggacagttagacggctggtggacaagtgggagaaagaaggactggccggcctggtgcagaaccagagagatgataagggcaagcaccgcgtgaacaagtactggcaagagttcgtgctgaccacctacaaagagaacaacaagggcagcaagcggatgacccggcagcaggttttcatcagagccaaggccagagccgacgagctgggaattgaacctcctagccacatgaccgtgtaccggatcctgaagcctctgatcgacaagcaagagcaggccaagagcatcagaagccctggctggcgaggcagcagactgagcgtgaaaaccagagatggcaaggatctgcaggtcgagcacagcaatcaagtgtggcagtgcgaccacaccagagtggatgtgctgctggtggatcagcatggcaagatcctgagcagaccctggctgaccacagtgatcgacagctacagccggtgcatcatgggcatcaacctgggctacgatgcccctagctctaccgtggttgctctggccctgagacacgccattctgcccaagcagtacagcagcgagtacggcctgcacgaggaatggggcacatatggcctgcctcagaacttctacaccgacggcggcaaggacttcagaagcaaccatctgcagcagatcggcgtgcagctgggcttcgtgtgtcacctgagagacagacctagcgaaggcggcagcgtggaaagacccttcaagaccctgaacaccgagctgttcagcaccctggccggctacacaggcagcaatgtgcaagagaggcctgaggaagccgagaaagaggcctgtctgacactgagacagctggaaaagatgctcgtgcggtacatcgtggacaactacaaccagcggatcgacgccagaatgggcgaccagaccaggtttcagagatgggagtctggcctgatcgccatgcctgatctgctgagcgagagagatctggacatctgcctgatgaagcagaccagacggcagattcagagaggcggctacctgcagttcgagaacctgatctatcggggagagctgctggccggatatgccggcgaatctgtggtgctgagatacgaccccaaggacatcacaaagatcctggtgtacagaatgagcgagggcaaagagatcttcctggccagagcttacgcccaggacctggaagccgaagaactgtctctggatgaggccaaggcctccagcagaaaagtgcgcgaaacaggcaaggccatcaacaaccggtctatcctggccgagatccgggaaagagagacattccctacacagaagaaaacccggaaagagcggcagaagctggaacagaccgaagtgaagaaggccaagcagctgacccctgtggaaaccgagaaggccatcgacgtggtgtccatcgatgccaagcctaccggcaagaacccagtggaaagcgagctgtgtaccgagtccggcgagctggatatgcctgaggtgctggactacgagcagatgcgcgaggactatggctggtga

SEQ ID NO: 1307 - DNA, 837 bp, Calothrix species
atggtggccaaagaggcccaagaggttgccaagcagctgggcgacatccccgtgaatgatgaacagctgcaggcccagatccaccggctgaacagaaagggcttcgtgcccctggaacaggtgcagacactgcacgattggctggaaggcaagcggcagtctagacagtctggcagagttgtgggcgagagcagaaccggcaagaccatgggctgtgacgcctaccggctgagaaacaagcctaagcaagaggccggcaagcctcctacagtgcccgtggcctatatccagattcctcaagagtgcggcgccaaagaactgttcggcgtgatcatggaacacctgaagtaccaagtgaccaagggcaccgtggccgagatcagagacagaaccctgagagtgctgaaaggctgcggcgtggaaatgctgatcatcgacgaggccgaccggttcaagcccaagacctttgctgaagtgcgggacatcttcgacaagctggaaatccctgtgatcctcgtgggcaccgacagactggatggcgtcatcaagagggacgaacaggtgtacaaccggttcagaagctgccacagattcggcaagctgagcggcgaggaattcaagcggaccgtggaaatctgggagaagaaggtgctgcagctgcctgtggccagcaacctgagcagcaagacaatgctgaagtccctgggcgaagccaccggcggatatatcggactgctggacatgatcctgagagagagcgccatcagagccctgaagaagggactgcagaagatcgacctggacaccctgaaagaagtgaccgccgagtaccggtga

SEQ ID NO: 1308 - DNA, 513 bp, Calothrix species
atggtcgaggaagagtacatcaaaccctggctgttccaagtggaacccttcgagggcgagagcctgtctcacttcctgggcagattcagacgggccaacgaactgacacctggcggactgggaaaagccacaggactcggcggagccattgccagatgggagaagttccggttcaaccctccacctgatggccagcagctggaaaagctggccgtggtcacagccatcaacgtggacagactgacccagatgctggcccctcctggaacaggcatgaagctggaacccatcagactgtgcggcgcctgttatgccgagtctccctgtcacaagatcgagtggcagttcaaagagacacagggctgcaagcaccacaagctgagactgctgagcgagtgccctaattgcggcgccagattcaaggtgcccgctctgtggatggatggctggtgccacagatgcttcacccctttcgtggaaatggtcaagtggcagaagcagaccaaccactga

SEQ ID NO: 1309 - DNA, 2142 bp, Calothrix species
atgagccagatcaccatccagtgcagactggtggccagcgccagcaccagacagaaactgtggaagctgatggccgagctgaacacccctctgatcaacgagctgctgatcctggtgtatcagcaccccgattttgaggcctggcggcacaaaggcgctatccctgtgggaaccatcaagcagctgtgcgagcccctgaaaaccgacgccagatttgtgggccagcctggcagattcttcgcctctgccattgccaccgtgtcctacatctacaagagctggatcaagatccagaagcggctgcagctccagatcgacggcaagaccagatggctggaaatgctgaacagcgacaccgagctggtggaaatggctggcgtggcactggataccctgagagccacagctaccgaactgctgaaccagctgaaccctcagcctaagaccgaggaaagccccaacaagaagggcaaaaagaccaagaaaacccagcagagccagggcgagagaagcctgagcaagatcctgttcgacacctacggcgataccgaggacatccagacaagatgcgccatctcctacctgctgaagaacggctgcaagatccgcagccaagaagaggacagcaagaagttcgccaagcggcggagaaaggtggaaatccagatccagagactgaccgaccagctggcctccagagttcccaagggcagagatctgacagccgccaagtggctggaagccctgtctatcgccgcctgcaaggtgccagagaatgaggccgaagccaagtcctggcagaacgccctgctgagacagagcagcagcctgccattttccgtggcctacgagacaagcgaggacatggcctggttctccaagctgaagctgaaccacatcagcatcaagctgtggaacatccctctgtacatcgactacctggtggtggccctgttcgtgcgggacagcctgaagaatgagatgctgtggttcaagaacctgaagatcaacaacagcgacgtgctgatgcagctgtggtttacccagctgaatatcaactgcctggccggcatcctgtttctgaatggcatcctgaagaagtacaagaagcggatctgcgtccacttcaacggcctgagcgattgcaccttcgagatctactgcgacagccggcacctccactggttcaagcggtttctggaagatcagcagatcaagaagaactccaagaaccagtacagcagctccctgttcaccctgcggagcggaagaattgcctggcagtctgctgaaggcaagggcaagccctggaacatcaaccacctgacactgagctgcaccgtggacaccagactgtggacagccgaaggatctcagctggtggccgaagagaaggccctggaaattaccaagagcatcacccggaccaaagagaaagagacaaaagagaagatcaagctgaacgacaaccagctcgcctacatcaagcggaaggacgccacactgacccggatcagcaacccatttcctcggcctagccagccactgtacaagggccagtctcacatcctcgtgggagtgtctctgggcctcgagaaacctgctacactggccgtgctgaatgccgtgaccggcaagatcattgcctaccggtctatcaaacagctgctgggcgagaactacaagctgctgaatcggcagagataccagaagcaggtcctgagccaccagcggaagatcgctcaaacactggctgcccctaaccagttcggcgattctgagctgggagagtacatcgatcggctgctggccaaagagattatcgctctggcccagaagttcaacgccggctctatcgtggtgcccaacctggacaacatgcgcgagcaagtgaactccgagatccaggccaaggccgaagaaaagtgtcccgagagcatcgaagcccagaagaaatacgccagcagctacaggcggagtgtgaatcagtggtcctaccggcggctgatcgactgcatcacaaatcaggccgccaaagccggcatcgtgatcgaggaaaagaagcagcccatccggggcagccctcaggacaaagctaaagagctggccctgagcgcctaccacgccagaaagaagtcttga

SEQ ID NO: 1310 - DNA, 458 bp, Calothrix species
tttaaaaaaccgaaccttgaaaatataatagtcattaacagcgccgcagttcatgcgccttacggcgcctctgtgctgtgcaaaatgtgggttagtttgactgttgtcagacagtcttgctttctgaccctggtagctgcccaccttgaagctgctatcccttgtggataggaatcaggtgcgcccccagtaatagaggtgcgggtttaccgcagtggtggctaccgaatcacctccgagcaaggaggaacccaccttaatttttatttttggcaaagcaaagcgggagctattttaccgggactggcgccaaaactttaaactccttatttaacaaagcttttggataaggcactgtcagttgatttatttttttagttttaactaacaagcgattttgtctgccatgccaaatttgcttctcagaatcttgataagtaaggagtctgaagcatgga

SEQ ID NO: 1311 - DNA, 37 bp, Calothrix species
gtttcagcgtccatctcagcttgaggcgggttgaaag

SEQ ID NO: 1312 - DNA, 510 bp, Calothrix species
  misc_feature (487)..(510): n is a, c, g, or t
tttaaaaaaccgaaccttgaaaatataatagtcattaacagcgccgcagttcatgcgccttacggcgcctctgtgctgtgcaaaatgtgggttagtttgactgttgtcagacagtcttgctttctgaccctggtagctgcccaccttgaagctgctatcccttgtggataggaatcaggtgcgcccccagtaatagaggtgcgggtttaccgcagtggtggctaccgaatcacctccgagcaaggaggaacccaccttaatttttatttttggcaaagcaaagcgggagctattttaccgggactggcgccaaaactttaaactccttatttaacaaagcttttggataaggcactgtcagttgatttatttttttagttttaactaacaagcgattttgtctgccatgccaaatttgcttctcagaatcttgataagtaaggagtctgaagcatggagaaatctcagcttgaggcgggttgaaagnnnnnnnnnnnnnnnnnnnnnnnn

SEQ ID NO: 1313 - DNA, 500 bp, Calothrix species
cagaatggcaaagaagtagtttaaaactggcaccgctcaaaaagtgctgtttgtaaaggttggtgccgataatctctaaagcagcagttcgtgttgtacattaactaattatttgtcaatttaacaaattattgtcacaaatgtaggaaatcctgaaaaccctgccatctaaaggtttgtggcaggttttttattattttaagattccaagcctgtcaaagcttaattaacatattaactgtcaaatcccagaaatataacacattaattgtcagttcccaaaaatcaaacaaattaatgattttataaaatttaacaaattctttgtccatttattaatataatacaactatgtttttataaaacacatctatgaaggatgcaaaatctactacaaactctgcaatgacacatgccagcattgcggatgtagaaaacggtaaagcagaagcaaatattattgtttctgaactgtcagatgaagctttgttaaaaatgga

SEQ ID NO: 1314 - DNA, 500 bp, Calothrix species
gtttcaacgtccatctcagcttgagacgggttgaaagattagataccccaagtaaggatctcctcccttctttgtttctattttattaaataaggtttaattatttaaaatgaatatttgatacttgtagtaatggttaatgttatcggtattaaccacagtgctattctactgtggaaactggtcagttatttttgccagcctgcactagctccgggacactaatctgttaatattgacatcaatctgttaaatgtgacattaatttgttaagagtgacaaataattagttaatgtacacgtgtatcagaatatggtattagtaaatttaccagaacttaaaagtggagttgtttgaatgactgaaccacataaagctaacggtaatgcggttgaagcttggccaagtctaccattcgataaatggaaggacacgtatgcaacactccatatgtggactcaaattattggaaaaattcgacttgtgcaaagtccattct

SEQ ID NO: 1315 - DNA, 1740 bp, Artificial Sequence
  Synthetic Oligonucleotide
atgggcgagacactgaacagcaacgaggtggacgagagcctggtgctgtacgatggctctgacgaagtggatgagatcagcgagagcgaggacaccaagcagaacaacgtgatcgtgaccgagctgagcgaagaggccaagctgagaatggaagtgctgcagagcctgatcgagccctgcgacagaaagacctacggcatcaagctgaagcaggccgccgagaagctgggaaagaccgtcagaacagtgcagcggctggtcaagaagtaccaagagcagggactgagcggcgtgacagaggtggaaagatctgacaaaggcggctaccggatcgacgacgactggcaggacttcatcgtgaaaacctacaaagagggcaacaaaggcggacggaagatgacccctgctcaggtggccatcagagtgcaagttcgcgctggacagctgggcctcgagaagtacccttgtcacatgaccgtgtaccgggtgctgaaccccatcatcgagcggaaagaacagaaacagaaagtgcggaacatcggctggcggggcagcagagtttctcaccagacaagagatggccagacactggacgtgcaccacagcaatcacgtgtggcagtgcgaccacaccaagctggatgtgatgctggtggaccagtacggcgaaaccctggctagaccttggctgaccaagatcaccgacagctacagccggtgcatcatgggcatccacctgggctttgatgcccctagctctctggtggtggccctggctatgagacacgccatgctgagaaagcagtacagcagcgagtacaagctgcactgcgagtggggcacatatggcgtgcccgagaacctgtttaccgacggcggcaaggacttcagaagcgagcacctgaagcagatcggcttccagctgggattcgagtgtcacctgagagacagacctccagaaggcggcatcgaggaaagaggcttcggaacaatcaataccgacttcctgagcggcttctacggctacctgggcagcaacgtgcaagagagagctgagggcgccgaggaagaggcctgtatcacactgagagaactgcatctgctgatcgtgcggtacatcgtggacaactacaaccagagaatcgacgccagaagcggcaaccagaccagattccagagatgggaagccggccttcctgctctgcccaacctggtcaacgaaagagagctggacatctgcctgatgaagaaaacccggcggagcatctacaaaggcggatacgtgtccttcgagaacatcatgtaccggggcgactacctgtctgcctatgccggcgaatctgtgctgctgagatacgaccccagagacatcagcaccgtgttcgtgtacagacaggacagcggcaaagaggtcctgctgtctcaggcccacgccatcgatctggaaaccgagcagatcagcctggaagagacaaaggccgccagcagaaagatccggaatgccggcaagcagctgagcaacaagtctatcctggccgaggtgcaggaccgggacacctttatcaagcagaagaagaagtcccacaaagagcggaagaaagaggaacaggcccaagtcaacttcgtgaagcctcctcagaccaacgagcccgtggaaaccgtggaagagatccctcagcctcagaaaagacggcccagagtgttcgactacgagcagctgcggaaggactacgacgattga

SEQ ID NO: 1316 - DNA, 837 bp, Artificial Sequence
  Synthetic Oligonucleotide
atggccgaggactacctgagaaaatgggtgcagaacctgtggggcgacgaccccattcctgaagaactgctgcccatcatcgagcggctgatcacacctagcgtggtggaactggaacacatccagaagatccacgactggctggacagcctgagactgagcaagcagtgcggcagaattgtggcccctcctagagccggcaagagcgtgacatgtgacgtgtacaagctgctgaacaagccccagaagagaaccggcaagcgggacattgtgcccgtgctgtatatgcaggtccccggcgaatgttctgccggcgaactgctgacactgatcctggaaagcctgaagtacgacgccatcagcggcaagctgaccgacctgagaagaagagtgctgcggctgctgaaagaaagcaaggtggaaatgctcgtgatcgacgaggccaacttcctgaagctgaacaccttcagcgagatcgcccggatctacgacctgctgaagatcagcatcgtgctcgtgggcaccgacggcctggacaacctgatcaagaaagagccctacatccacgaccggttcatcgagtgctacagactgcctctggtgtccgagaagaaattccccgagttcgtgcagatctgggaagatgaggtgctgtgcctgcctgtgcctagcaatctgaccaagcgcgagacactgatgcccctgtaccagaaaacctccggcaagatcggcctggtggacagagttctgagaagggccgccatcctgagcctgagaaagggcctgaagaatatcgacaaggccacactggacgaggtgctcgagtggttcgaatga

SEQ ID NO: 1317 - DNA, 531 bp, Artificial Sequence
  Synthetic Oligonucleotide
atggaaatccctgccgagcagcccagattcttccaggtggaacctctggaaggcgagagcctgtctcacttcctgggcagattcagaagagagaactacctgaccgccacacagctgggcaagctgacaggcattggagccgtgatcagcagatgggagaagttctacctgaatccgtttccgacacctcaagagctggaagccctggccgctgtggtggaagtgaaagtggaccggctgatcgagatgctgcctcctagaggcgtgaccatgaagcccagacctatcagactgtgcagcgcctgctaccaagagtccccttgccacagagtggaatggcagttcaaggacgtgatggtctgcgactgcctgagacactgccctctgaacaacagacaccagctggccctgctgaccaagtgcaccaattgcgagacaccctttcctatacctgccgactgggtgcagggcgagtgccctcactgttttctgcccttcaccaagatggccagacggcagaagcggtactga

SEQ ID NO: 1318 - DNA, 1923 bp, Artificial Sequence
  Synthetic Oligonucleotide
atgagcgtgatcaccatccagtgcagactggtggccgacgacaaagccctgagacacctgtgggaactgatggccgagaagaacacccctctggtcaacgagctgctggacagactgggcaagcacaccgattttgaggcctgggtgcaagccggcaaggtgccaaagacaaccatcaaggccctgtgcgacagcctgaaaacccaagagcctttcatcggccagccaggcagattctacaccagcgccacaactctggtggcctacatctacaagtcttggctggccctgcacaagcggcggcagagaaagattgagggcaaagaacggtggctggaaatgctgaagtccgacgtggaactggaacaagagagcaacagcagcctggaactgatccggacaatcgccaccgagatcctgagcaagtttagcgccagcagcaccgacggcatcaaccagaagtccaagggcaagaagtctaagaagctgaagaaggacaaggccgacgagcccatgagcatcaaacctggcgtgctgttcgaggcctaccagaaaaccgaggacatcctgcggagaagcgccctggtgtacctgatcaagaacaactgccaagtgaacttcgccgaagaggaccccgataagtacgccaagatgcggcggaagaaagagatcgagatcgagcggctgaaagagcagctgaagtctcgggtgcccaagggcagagatctgaccggaaagaagtggctcgagacactggaaaaggccgtgaacagcatccctcaggacgagaacgaggccaaatcttggcaggccggactgctgagaaagtccagcaccgtgccatttccagtggcctacgagactaacgaggacatgcactgggagatcagcgataagggaagaatcttcgtgtccttcaacggcctgtccaagctgaagctggaagtgtactgcgaccagcggcatctgccctggttccagagattcgtggaagatcaagagacaaagcgcaaggggaagaaccagcacagcagcggcctgttcacactgagaagcggcagactgagctggctgaagcaagaaggcaagggcgaaccttggagcgtgaaccggctgatcctgttctgtagcgtggacaccagaatgtggaccgtggaaggcacacagcaggtcgccatcgagaagatcgccgatgtggaacagaacctgaccaaggccaaagagaagggcgagctgaacagcaaccagcaggccttcgtgaccagacagcagagcacactggccaagatcaacaccccatttccacggcctagcaagcccctgtacgagggcaagtctcacatcctcgtgggagtgtctctgggcctcgagaatcctgctaccgtggccgtgttcgacgctgtgaacaacaaggtgctggcctacagaagcgtgaaacagctgctgggcaacaactacaacctgctgaaccgacagcagcagcagaagcagagactgtcccacgacagacacaaggcccagaaggacttcgccagaaacgacttcggcgagtctgagctgggccagtatgtggatagactgctggccaaagaaatcgtggccattgccgtgacctacttcgccggctctatcgtgctgcctaagctgggcgacatgagagagatcatccagagcgaggtgcaggccagagccgagaaaaagatccccggcttcaaagagggccagcagaaatacgccaaagaataccggaaacaggtgcacaactggtcctacggcaggctgatcgagaatatccagagccaggccgccaaagtgggcatcctgattgagacaggccagcagccaatccggggctctccacaagaacaggctagagatctggccctgttcgcctaccagtgtaggatcgccagctccatctga

SEQ ID NO: 1319 - DNA, 495 bp, Artificial Sequence
  Synthetic Oligonucleotide
tcaatctaaacaaaataccgaaccttgaaaacttaatatgaaagtaacagcgccgcagttcatgctcttctgagtctctgtactgtgataaatctgggttagtttaacggttgaaagaccgttttgctttctgaccctggtagctgctcgctcttgatgctgctgtcttttgacaggataggtgcgctcccagcaataaagagttaaagctgataaagcttgagccgttgtaaaacggtggggtttacctcagtggtggctactgaatcacccccttcgtcgggggaaccctcctaaatattttttttggcgtgtcaaagcgggggcaaaaatcctggagtcccgccaaaatctcaaaacctttgtcctatcttgacttgataaactagcatgtcagttaatttagttttttgatgtcaagtaggagatgcttttaggcagtcctgccaaagatgtgtatggaaagctctaatagcaagggttctagacggatcg

SEQ ID NO: 1320 - DNA, 37 bp, Artificial Sequence
  Synthetic Oligonucleotide
gtttcaacaaccatcccagctaggggtgggttgaaag

SEQ ID NO: 1321 - DNA, 547 bp, Artificial Sequence
  Synthetic Oligonucleotide
  misc_feature (524)..(547): n is a, c, g, or t
tcaatctaaacaaaataccgaaccttgaaaacttaatatgaaagtaacagcgccgcagttcatgctcttctgagtctctgtactgtgataaatctgggttagtttaacggttgaaagaccgttttgctttctgaccctggtagctgctcgctcttgatgctgctgtcttttgacaggataggtgcgctcccagcaataaagagttaaagctgataaagcttgagccgttgtaaaacggtggggtttacctcagtggtggctactgaatcacccccttcgtcgggggaaccctcctaaatattttttttggcgtgtcaaagcgggggcaaaaatcctggagtcccgccaaaatctcaaaacctttgtcctatcttgacttgataaactagcatgtcagttaatttagttttttgatgtcaagtaggagatgcttttaggcagtcctgccaaagatgtgtatggaaagctctaatagcaagggttctagacggatcggaaatcccagctaggggtgggttgaaagnnnnnnnnnnnnnnnnnnnnnnnn

SEQ ID NO: 1322 - DNA, 600 bp, Artificial Sequence
  Synthetic Oligonucleotide
agttttgtgttgcacaaaccatcctaagcgacattagtttgcaaaaaacgacattaatttacgaatcgcgacctttaatttgcgaatatacaacagattttgtcgattaactaattatttgtcgtcttaacaaattaatgtcgcccaaatcttcaagactataatccttatgtatcaaaggttatagccttttgaacttatattggctatcatcaaatatttaactaattaagtgtcgtcttttaattaattaacattttaaatgtcgttttttcaaaaaacacctttccaaatttttcttttgctcataacaaaataactgtcgtcttttggaagtgagtgaaaaatataaaattaaatgtcgctttttggaacaaagtagtatgatatttattaggcaatagtagctatgtaacaacaaaaacatagttagattgaagtcttcttttttgtctctagctacgaagtcattacccttgctgcgattaaatttagacgcaagctaatttcgctcttagacttgctgtaccgtattgcctaaccaactagtttcaagcgatgaagtttgtttatgggtgaaacgctaaactccaacgaggt

SEQ ID NO: 1323 - DNA, 500 bp, Artificial Sequence
  Synthetic Oligonucleotide
gtttcaacaaccatcccggctaggggtgggttgaaagtttaagttctattaactccaagttttaataattgcatggcaataacaatcctttttagaaaggatttaagagggttgaaaggaatgtcaccttcccaagaatacttttcaaaagctattttgggttagggaagaataatcacagataactaatatgcacaagtaagtctaaaatagggataagtctgtcgattagtccaatagcaaggcatcttgttagacgacattaatttgttaacgttagttggaactaattcgacgacattaattcgttaacagcgacattaatttgttaatgacgacattaatctgttaacgacgacattaatctgttaacgacgacaaataatctgttaattgacagatttgaaagcgggtgatgggactcgaacccacgacgttcaccttgggaaggtgacattctaccactgaattacacccgcaaatggagtttaggctcaata

SEQ ID NO: 1324 - DNA, 2019 bp, Artificial Sequence
  Synthetic Oligonucleotide
atgacactggtgctgcacaccatcagcatcttcgtgctgctgaccgagagcagattcgcctctcctcctctgctggccaacttcctgtctagcagcaagctgttccagaaagagagcggcatcttcatcctgttcaccctgaagtggcagcagcccagcatggatgaatcccaggtggcctgcctggatgccgatcctcaggatttcgatgaggtggtgctgagcagccacgccttcgataccgatcctagcaagatcctgatcgacagcagcgaccggcacaagctgcggttcagactgattgagtggctggccgaggctcccaacagaaaagtgaaggccgagagaaagggcgccatcagcaagaccctggacatcagcaccagacaggtggaacggatgctgaaccagtacaacgccgacaagctgagagagacagccggcatcgagagagccgacaagggcaaccacagaatcgacgagtactggcaggactacatccgcgaggtgtacgagaagtccctgaaggacaagcaccctctgaagcccgccgatgttgtgcgggaagtgcatagacacgccgtgatcgacctgagacacgaggaaggcgattggcctcacgccgccaccgtgtacagaatcctgaagcctctggtcaagcggcacaagaggaaccagaagatcagaaaccctggcagcggcagctggctggctgtggaaacagaggatggcaagctgctgaaggccaatttcagcaaccagatcgtgcagtgcgaccacaccaagctggacatccggatcatcgacaaggacggaaagctgctgtcttggaggccttggctgaccaccgtggtggacacctttagcagctgcctgatcggctaccagctgtggcacaaacagcctggcgctcacgaagtggccctgacactgagacatgccatcctgcctaagcagtaccccgccgactacgagctggaaaagccctggaatatctacggcgctcccctgcagtacttcttcaccgacaaaggcaaggacctgagcaagagcaagctgatcaaggccctgggcaagaaactgggcttccagtgcgagctgagggacagacctatccaaggcggcatcgtggaacggctgttcaagaccatcaacaccgaggtgctggctcctctgccaggctacatcagcaaagaagaggacggcgccgagcgggccgaaaaagaggcctgttttaccatcgaggacatcgataagatcctggccagctacttctgcgacgactacaaccaccagccttatcctaaggaccctcacgacaccagattcgagcggtggtttagaggcatgggcaacaagctgcccgagcctatggatgagcgcgagctggatgtgtgcctgatgaaggaagaacagagagtcgttcaggcccacggcagcgtgtacttcgagaacctgacctacagatgcgaggaactgcggagcctgaagggcgagtacgtgaccgtgacctacgatcccgaccacattctgaccctgtacatctaccggcagagcacctctgatgaggccggcgagtttatcggatacgcccacgccatcaacatggacacccaggatctgagcctggacgagctgaagcagctgaacaaagccagaagcagcgccaagagagagcacagcaatttcgacgccctggtgtccctggacaagagacagaaactggtggaagagaggaagcaagagaagaaagagcggcagcggagcgagcagaagaagctgaggggaaagtccaagcaggacagcaaggtggtggaactgagaaaggacagagccggcaagagcacaaaccccaccgagtccatggaactgctgcctgagagagtgtcccctgagcagatgaagccactgagccctccaacacctcctattccagaacctgccgccagcgctccttctacacaagaaagacacaagctcgtgatccccaagaatcagaccctgaagcggatctggtga

SEQ ID NO: 1325 - DNA, 867 bp, Artificial Sequence
  Synthetic Oligonucleotide
atggctcagcctcagctggctgtgcatgtgcctgtggaagttctggccccacagctggatctgacagacgtgctggccaagacagccgccatcgaggaactgttcaagaccgccttcattcccaccgacagagccagccagtacttcagatggctggacgagctgcggctgctgaagcagtgtggaagagtgatcggccccagagatgtgggcaagagcagatcctccgtgcactacagagaagaggaccggaagcggatcagctgcgtgaaggcctggtctaacagcagcagcaagcggctgttcagccagatcctgaaggacatcaaccacgccgctcctcggggcaagagacaggatctgagatctagactggccggctgcctggaacctttcggaatcgaactgctgctgatcgacaacgccgagaacctgcagagagaggccctgatcgatctgaagcagctgcacgaggaatccggcgtgccagtgattctcgttggaggccaggacctggatagcagcctgcagaatctggacctgctgacctgctttcccacactgttcgacttcgaccggctggactacgacgacttccagaaaaccctgcggaccatcgaactggatctgctggcactgccccagcctagcaatctgtctgagggcaccctgttcgagatcctggccacatctacccaggccagaatgggcgtgctgatcaagatcctgaccaagaccgtgctgcacagcctgaagaaaggccacggaaaggtggacgaggccatcctgcacaatatcgcctccagatacggcaagcagtacacaagccccgaggccagaaagaagcctggactgtctgaaggctga

SEQ ID NO: 1326 - DNA, 564 bp, Artificial Sequence
  Synthetic Oligonucleotide
ctgaagtccatcttcctggaaggcgagagcgccatgagccacctggaagagaatgtgcccagactgggctacgtggaacccctggaacacgagagcatcagccactacctgggcagactgcggagattcaaggccaactctctgcccagcgcctactctctgggacaagccgctggaattggagccgtgacagccagatgggagaagctgtacttcaacccctttccaactgccgccgagctggaagccatcgagagactgatcggcctgaacaccggcagactggaagctatgctgccccacagaggcatgaccctgcagcctagacctatcagactgtgcggcgcctgctacaccgagtctccctgtcacagaatggaatggcagtacaaggacgtggtggccgtgtgtcctcaccactctctgagactgctggaaagatgccccagctgcaagacccctttcaagatccctgctctgtggaccgacggcacctgtgatcactgcggcatgagattcaccagcatggtcaagtaccaagagcggatcaagaaaaccggctga

SEQ ID NO: 1327 - DNA, 1770 bp, Artificial Sequence
  Synthetic Oligonucleotide
atgagcatcatcaccatccactgccggctgatcgccagcgagcctattagaaggcatctgtggcagctgatgagcagaagcaacacccctctgatcaacgacctgctgaaacaggtgtcccaccacgccgacttcgagacatggcagtctagaggcaccgtgcctagcaacgccatcagagatctgtgcgagcccctgaaagaggtgtaccctggacagcccgccagattctatgccagcgccatcctgatggtcacctacacctacgagtcttggctggccctgcagcagaccagaagaagaaggctgaacggcaagcagcggtggctgaacgtggtcaagtctgatgccgaactgctgggcctgagcggcagcacactggaatccattagacagagagcccaggacatcctgagccagctgaacaccgagatggaaacccagttcgccccatctcctaagaagcggagcaagcggagaggccagacacacagcagcaatgacgccagcctgatgagccggctgttcacagcccatgacaccgccgatgacatcctgtctcagtgcgctatcgcccatctgctgaagaacggctgcaagatcagcgaaaccgaggaagagagcgagaagttcgcccaccggatccaccggaagcagaaagagatcgagcagctggaagcccagctgcaggccagacttcctaagggaagagatctgaccggcgacgtgttcctggaaaccctggaaatcgccactcagcagatccccgagacagtgatccaggccagagagtggcaggccaagctgcttgctagacctgccagcctgccttatcctatcatctacggcagcagcaccgacgtgcggtggtctaagaccgccaacgatagaatcgccgtgtccttcaacggcatcgacaagtacctgaaggacgccgatcctgagatccaagagtggttcaagctgcacaaagaataccccttccgggtgttctgcgaccagagacagctgcccttcttccaacgcttcctggaagattggcaggcctaccaggccaacaaggacacatatcctgccggcctgctgaccctgtctagcgctacacttgcttggagagaaggcgaaggcaaaggcgagccctgggaagtgaatcacctggtgctgcactgcgccttcgacaccagactgatgtctgccgaaggcaccctcgagatccagcaagagaagtccacaaaggccctgaagaacctgacacacgacaaccccgatcctcggaaccagagcaccctgaaccggctgaagaatgtgcccgagaggcctagcagaaagccctaccagggcaatcccgagatcctcgtgggactgtctatcggcctggctgatccagtgacagccgccgtggttaatggcagaacaggcgaggtgctgacctacagaacccctagaacactgctgggagagcactaccatctgctcaacagacactgccagcagcagcaacagaacgccctgcagaggcacagaaaccagaaacggggcgtgacctaccagcctagcgagtctgaactgggccagtacgtggacagactgctggccaacagcatcatccagctggcccagacacatcaggccggctctatcgtgatccccagcctgacacatctgagagagctgctggcctctgagatcacagccaaggccgagcggaagtccagaatcgtggaagtgcaggataagtacgccaaagagtaccggatcgccattcactga

SEQ ID NO: 1328 - DNA, 582 bp, Artificial Sequence
  Synthetic Oligonucleotide
taatttcctctcctaagccatttgaacctagataatttaatataaagtctaacagcgccgcagtttaagctctacagccgctgaactgtgaaaaatgtgggtcagtttggtcgttgcaagacgatcgtgctttccgaccctagtaactgtccgctcactgactgccatcctgggacaaatcttcaaattttgtggatttgtatggggatggaaagctgcattaggcgattctctttctctaatgtagcgcaggtgcgcacccagcagaagtgagtcaagccttcacaatgtggaggtacaggagcatcatctctcattttttagtgtaaatggtgtgactgaagtggtagttaccgaatcgcccctgatcaagggggaaccctccataattttttggcaaaccgaagcgaggttcaaaatcctgggaggtttgccaaagtccaaaaccttgctgttagtgcgactttcacaactctggtaatcactaaaggggtgtttgtgatgcagctaaacagcgggtttaaacaggtttgccaaaacttgacttggaaagcttgtaggacaagtattctagcgctggga

SEQ ID NO: 1329 - DNA, 37 bp, Artificial Sequence
  Synthetic Oligonucleotide
gttgcgatcgccctcccagagatgggtgggttgaaag

SEQ ID NO: 1330 - DNA, 634 bp, Artificial Sequence
  Synthetic Oligonucleotide
  misc_feature (611)..(634): n is a, c, g, or t
taatttcctctcctaagccatttgaacctagataatttaatataaagtctaacagcgccgcagtttaagctctacagccgctgaactgtgaaaaatgtgggtcagtttggtcgttgcaagacgatcgtgctttccgaccctagtaactgtccgctcactgactgccatcctgggacaaatcttcaaattttgtggatttgtatggggatggaaagctgcattaggcgattctctttctctaatgtagcgcaggtgcgcacccagcagaagtgagtcaagccttcacaatgtggaggtacaggagcatcatctctcattttttagtgtaaatggtgtgactgaagtggtagttaccgaatcgcccctgatcaagggggaaccctccataattttttggcaaaccgaagcgaggttcaaaatcctgggaggtttgccaaagtccaaaaccttgctgttagtgcgactttcacaactctggtaatcactaaaggggtgtttgtgatgcagctaaacagcgggtttaaacaggtttgccaaaacttgacttggaaagcttgtaggacaagtattctagcgctgggagaaatcccagagatgggtgggttgaaagnnnnnnnnnnnnnnnnnnnnnnnn

SEQ ID NO: 1331 - DNA, 500 bp, Artificial Sequence
  Synthetic Oligonucleotide
gagcgttacctcgttaagggtcgcttgatctgctaattctctcagcgctcgtgattcttggctatgaatttgctgatcagcgcagatgatatgggccagcagcaagaagccatagtctaatgctgcactagattgagaagatacaatagctaccatctggagattcttgttgaagtcttgatttatctagcgaacttctcacaggatgcccggatttgactctagtgcttcacacaatctctatctttgtattgcttaccgagagccgcttcgcctctcctccattactggcaaatttcctatcgtcatctaaactatttcagaaggaaagtggtatttttatactattcactttgaagtggcagcaaccttctatggacgaaagccaagttgcctgtttagatgctgacccacaagacttcgatgaagtggtgttgagcagtcatgccttcgacactgacccatccaaaatcctgatagactcatcagaccgtcacaaa

SEQ ID NO: 1332 - DNA, 500 bp, Artificial Sequence
  Synthetic Oligonucleotide
gttgcaatcgccctcccaaaaacggatgggctgaagccatttttaattcttaaagctttggggggctgaaaggagcgctgcaatggcactgttaattgcattcagtcatacttaacagttgcgcctgtagcgacattattctgcgaattgtaaaagattcgccttttgcgacattattctgcaaatttcagtaagatacagcaaaaaagtccttaaacgacattaatttgcgaattgcgacatttaatgtgcgaacgtacagaaagaaatggagttaagcgggttcgaaccgctgacctctgcaatgccattgcagcgctctaccaactgagctataacccctcatttcgtattttatcatggcgcaatcctaatcattcagtcaagcgtcaactttggtaagctgataaacgtatcgcccctcaacagaaaatgagagccgtttgagacttatgactgagacaccccaagagttacctaattctgatcttgagacaggt

What is claimed is:

1. An engineered nucleic acid targeting system for insertion of donor polynucleotides, the system comprising:
    a. one or more CRISPR-associated Tn7 transposase or Tn7-like transposase proteins that form a transposase;
    b. a catalytically inactive Type V Cas protein capable of forming a complex with the transposase;
    c. a guide molecule capable of forming a complex with the Type V Cas protein and directing sequence-specific binding of a guide-Cas protein complex to a target sequence of a target polynucleotide; and
    d. a donor construct, comprising a heterologous donor polynucleotide sequence flanked by a first and second binding sequence capable of complexing the donor construct with the one or more Tn7 or Tn7-like transposase proteins.

2. The system of claim 1, wherein the one or more CRISPR-associated transposase proteins comprises i) TnsB and TnsC, or ii) TniA and TniB.

3. The system of claim 1, wherein the one or more CRISPR-associated transposase proteins comprises:
    a. TnsA, TnsB, TnsC, and TniQ,
    b. TnsA, TnsB, and TnsC,
    c. TnsB, TnsC, and TniQ,
    d. TnsA, TnsB, and TniQ,
    e. TnsE,
    f. TniA, TniB, and TniQ,
    g. TnsB, TnsC, and TnsD,
    h. TnpA, or
    i. any combination thereof.

4. The system of claim 3, wherein the TnsE does not bind to DNA.

5. The system of claim 1, wherein the one or more CRISPR-associated transposase proteins comprises TnsB, TnsC, and TniQ.

6. The system of claim 5, wherein the TnsB, TnsC, and TniQ is selected from SEQ ID NOs: 829, 831, 833, 837, 839, 841, 845, 847, 849, 853, 855, 857, 861, 863, 865, 869, 871, 873, 877, 879, 881, 885, 887, 889, 893, 895, 897, 901, 903, 905, 909, 910, and 911, or are encoded by polynucleotides selected from SEQ ID NOs: 828, 830, 832, 836, 838, 840, 844, 846, 848, 852, 854, 856, 860, 862, 864, 868, 870, 872, 876, 878, 880, 884, 886, 888, 892, 894, 896, 900, 902, 904, 917, and 918.

7. The system of claim 1, wherein the heterologous donor polynucleotide sequence is to be inserted at a position between 40 and 100 bases downstream from a PAM sequence in the target polynucleotide.

8. The system of claim 1, wherein the heterologous donor polynucleotide sequence:
    a. introduces one or more mutations to the target polynucleotide,
    b. introduces or corrects a premature stop codon in the target polynucleotide,
    c. disrupts a splicing site,
    d. restores or introduces a splicing site,
    e. inserts a gene or gene fragment at one or both alleles of the target polynucleotide, or
    f. a combination thereof.

9. The system of claim 8, wherein the one or more mutations introduced by the heterologous donor polynucleotide sequence i) comprises substitutions, deletions, insertions, or a combination thereof, or ii) causes a shift in an open reading frame on the target polynucleotide.

10. The system of claim 1, wherein the heterologous donor polynucleotide is between 100 bases and 30 kb in length.

11. The system of claim 1, wherein the system further comprises a trans-activating CRISPR (tracr) sequence.

12. The system of claim 1, wherein the Cas protein is Cas12k.

13. The system of claim 12, wherein the Cas12k is i) encoded by a polynucleotide selected from SEQ ID NOs: 834, 842, 850, 858, 866, 874, 882, 890, 898, 906, 967, 976, 985, 994, 1003, 1012, 1021, 1030, 1039, 1048, 1057, 1066, 1075, 1084, 1093, 1102, 1111, 1120, 1129, 1138, 1147, 1156, 1165, 1174, 1183, 1192, 1201, 1210, 1219, 1228, 1237, 1246, 1255, 1264, 1273, 1282, 1291, 1300, 1309, 1318, and 1327
    or is a protein comprising SEQ ID NO: 835, 843, 851, 859, 867, 875, 883, 891, 899, 907, or 912, or ii) of an organism selected from *Leptolyngbya frigida* ULC18, *Phormidium tenue* NIES 30, filamentous cyanobacterium CCT1, *Chamaesiphon minutus* PCC 6605, *Geitlerinema* sp PCC 7407, *Leptolyngbya ohadii*, *Aphanocapsa montana* BDHKU210001, filamentous cyanobacterium CCP4, *Phormidesmis priestleyi*, filamentous cyanobacterium CCP2, *Leptolyngbya ohadii*, filamentous cyanobacterium CCP2, *Cyanothece* sp PCC 7425, filamentous cyanobacterium CCP5, *Trichormus variabilis* ATCC 29413, *Nostoc* sp *Peltigera membranacea* cyanobiont 232, *Cyanothece* sp PCC 8801, *Scytonema hofmanni* PCC 7110, *Calothrix* sp PCC 7103, *Nostoc* sp NIES 2111, *Calothrix* sp NIES 2100, *Scytonema* sp HK 05, *Nostoc* sp *Peltigera malacea* cyanobiont DB3992, *Nostoc* sp NIES 4103, *Nostoc* sp PCC 7107, *Nostoc piscinale* CENA21, *Nostoc* sp MBR 210, *Nostoc* sp NIES 3756, *Trichormus variabilis* ATCC 29413, *Anabaena* sp 4 3, *Nostoc* sp CENA543, *Nostoc* sp HK 01, *Chlorogloea* sp CCALA 695, *Anabaena cylindrica* PCC 7122, *Aphanizomenon flos aquae, Calothrix* sp PCC 6303, *Nodosilinea nodulosa, Aphanocapsa montana* BDHKU210001, *Leptolyngbya* sp, *Leptolyngbya boryana* IAM M 101, *Nostoc linckia* zl, *Fremyella diplosiphon* NIES 3275, *Tolypothrix* sp PCC 7601, *Anabaena* sp WA102, *Cuspidothrix issatschenkoi* CHARLIE 1, *Mastigocoleus testarum* BC008, *Calothrix* sp NIES 4101, *Calothrix parasitica* NIES 267, *Pseudanabaena frigida, Hassallia byssoidea* VB512170, *Anabaena* sp WA113, *Chlorogloea* sp CCALA 695, *Tolypothrix tenuis* PCC 7101, *Trichormus variabilis* NIES 23, *Nostoc* sp PCC 7120, *Nostoc carneum* NIES 2107, *Scytonema hofmanni* UTEX B 1581, *Nostoc punctiforme* PCC 73102, filamentous cyanobacterium CCP3, *Alkalinema* sp CACIAM 70d, *Microcoleus* sp PCC 7113, *Crinalium epipsammum* PCC 9333, *Cyanobacterium aponinum* IPPAS B 1201, *Geminocystis* sp NIES 3708, *Geminocystis* sp NIES 3709, *Cyanobacterium* sp HL 69, *Cyanobacterium* sp IPPAS B 1200, *Geminocystis* sp NIES 3709, *Myxosarcina* sp GI1, *Xenococcus* sp PCC 7305, *Gloeocapsa* sp PCC 73106, *Cyanothece* sp PCC 8802, *Cyanothece* sp CCY0110, *Cyanothece* sp PCC 8801, *Spirulina major, Halothece* sp PCC 7418, *Nostoc flagelliforme* CCNUN1, *Tolypothrix* sp PCC 7601, *Tolypothrix tenuis* PCC 7101, *Nostoc cycadae* WK 1, *Nostoc cycadae, Nostocaceae Nostoc* sp KVJ20, and *Scytonema* sp NIES 4073.

14. The system of claim 1, wherein the one or more transposase proteins comprises TnsB, TnsC, and TniQ, and the Cas protein is Cas12k.

15. The system of claim 1, wherein the Cas protein lacks nuclease activity.

16. The system of claim 1, wherein the Cas protein comprises an activation mutation, a DNA-binding domain, or a combination thereof.

17. The system of claim 16, wherein the DNA binding domain is a dead Cas protein, or an RNA-guided DNA binding domain.

18. The system of claim 1, wherein the target polynucleotide has i) a PAM on the 5' side of the target and comprises TTTN or ATTN, or ii) a PAM comprises NGTN, RGTR, VGTD, or VGTR.

19. The system of claim 1, wherein the guide molecule comprises a guide sequences selected from SEQ. ID NOs: 804, 807, 810, 813, 816, 819, 821, and 824.

20. An engineered system comprising one or more polynucleotides encoding components (a), (b) and/or (c) of claim 1, or a vector comprising the one or more polynucleotides.

21. An isolated cell comprising the system of claim 1, or a progeny thereof.

22. A method of inserting a donor polynucleotide into a target polynucleotide in a cell, which comprises introducing into the cell:
   a. one or more CRISPR-associated Tn7 transposase or Tn7-like transposase proteins that form a transposase,
   b. a catalytically inactive Type V Cas protein capable of forming a complex with the transposase,
   c. a guide molecule capable of forming a complex with the Type V Cas protein to form a CRISPR-Cas complex and directing sequence-specific binding of a guide-Cas protein complex to a target sequence of a target polynucleotide, and
   d. a donor construct comprising a heterologous donor polynucleotide sequence flanked by a first and second binding sequence capable of complexing the donor construct with the one or more Tn7 or Tn7-like transposase proteins,
   wherein the CRISPR-Cas complex directs the one or more CRISPR-associated transposases to the target sequence and the one or more CRISPR-associated transposases inserts the heterologous donor polynucleotide into the target polynucleotide at or near the target sequence.

* * * * *

UNITED STATES PATENT AND TRADEMARK OFFICE
CERTIFICATE OF CORRECTION

| | | |
|---|---|---|
| PATENT NO. | : 11,384,344 B2 | |
| APPLICATION NO. | : 16/717713 | |
| DATED | : July 12, 2022 | |
| INVENTOR(S) | : Feng Zhang et al. | |

It is certified that error appears in the above-identified patent and that said Letters Patent is hereby corrected as shown below:

In the Specification

In Column 5, Line 67, delete "hoffmanni" and insert -- hofmannii --.

In Column 5, Line 67, delete "2349" and insert -- 2349. --.

In Column 6, Lines 1-2, delete "hoffmanni" and insert -- hofmannii --.

In Column 6, Line 44, delete "37 C" and insert -- 37° C. --.

In Column 6, Line 44, delete "37 C." and insert -- 37° C. --.

In Column 10, Line 19, delete "Coomassiestained" and insert -- Coomassie stained --.

In Column 11, Line 4, delete "chloerae." and insert -- cholerae. --.

In Column 12, Line 21, delete "45.C" and insert -- 45C. --.

In Column 12, Line 41, delete "Heliocobacter" and insert -- Helicobacter --.

In Column 18, Line 35, delete "transpoase" and insert -- transposase --.

In Column 20, Line 42, delete "transponson" and insert -- transposon --.

In Column 23, Line 14, delete "Flavobactrium aciduliphilum" and insert -- Flavobacterium aciduliphilum --.

In Column 23, Line 18, delete "Alkalitala" and insert -- Alkalitalea --.

In Column 24, Line 30, delete "reconized" and insert -- recognized --.

Signed and Sealed this
Sixth Day of June, 2023

Katherine Kelly Vidal
*Director of the United States Patent and Trademark Office*

In Column 24, Line 41, delete "length" and insert -- length. --.

In Column 34, Line 8, delete "39 40," and insert -- 39, 40, --.

In Column 34, Line 9, delete "47 48," and insert -- 47, 48, --.

In Column 36, Line 21, delete "ethyl(cEt)," and insert -- ethyl (cEt), --.

In Column 36, Lines 40-41, delete "deoxyribonucletides" and insert -- deoxyribonucleotides --.

In Column 36, Line 57, delete "ethyl(cEt)," and insert -- ethyl (cEt), --.

In Column 36, Line 65, delete "ethyl(cEt)." and insert -- ethyl (cEt). --.

In Column 38, Line 20, delete "sufonyl," and insert -- sulfonyl, --.

In Column 41, Lines 44-45, delete "Crytochrome" and insert -- Cryptochrome --.

In Column 44, Line 30, delete "TranHuuHue" and insert -- Tran-Huu-Hue --.

In Column 47, Line 52, delete "CRISPR/Cas9" and insert -- "CRISPR/Cas9 --.

In Column 47, Line 54, delete "2015)" and insert -- 2015). --.

In Column 47, Line 55, delete "Crystal" and insert -- "Crystal --.

In Column 47, Line 56, delete "2015)" and insert -- 2015). --.

In Column 48, Line 7, delete "2016)" and insert -- 2016). --.

In Column 48, Line 63, delete "Effectors" and insert -- Effectors. --.

In Column 52, Line 62, delete "US2014-" and insert -- US 2014- --.

In Column 54, Line 15, delete "HEMATOPOETIC" and insert -- HEMATOPOIETIC --.

In Column 54, Lines 39-40, delete "12-F EB-14," and insert -- 12-FEB-14, --.

In Column 66, Line 29, delete "cerivisae" and insert -- cerevisiae --.

In Column 66, Line 35, delete "transpoase" and insert -- transposase --.

In Column 66, Line 40, delete "(Lucklow" and insert -- (Luckow --.

In Column 67, Line 14, delete "DIMRIE C," and insert -- DMRIE-C, --.

In Column 67, Line 15, delete "Effectin" and insert -- Effectene --.

In Column 67, Line 23, delete "sono-poration" and insert -- sonoporation --.

In Column 69, Line 2, delete "art.," and insert -- art, --.

In Column 69, Line 45, delete "hydroylase" and insert -- hydroxylase --.

In Column 70, Line 58, delete "Pkysiol." and insert -- Physiol. --.

In Column 76, Line 8, delete "TocsiBACE" and insert -- Toc-siBACE --.

In Column 76, Line 63, delete "TocsiBACE" and insert -- Toc-siBACE --.

In Column 77, Lines 15-16, delete "poly(polyproylenimine)," and insert -- poly(polypropyleneimine), --.

In Column 81, Line 57, delete "Immuno deficiency" and insert -- Immunodeficiency --.

In Column 82, Line 35, delete "Immuno deficiency" and insert -- Immunodeficiency --.

In Column 82, Line 35, delete "immuno deficiency" and insert -- immunodeficiency --.

In Column 86, Line 18, delete "4C." and insert -- 4° C. --.

In Column 86, Line 36, delete "used/and or" and insert -- used and/or --.

In Column 86, Line 46, delete "(RetroNectin,Takara" and insert -- (RetroNectin, Takara --.

In Column 90, Line 14, delete "and or" and insert -- and/or --.

In Column 91, Line 20, delete "isoelectropoint" and insert -- isoelectric point --.

In Column 95, Line 20, delete "molcule(s)" and insert -- molecule(s) --.

In Column 96, Line 10, delete "braches." and insert -- branches. --.

In Column 96, Line 35, delete "AAV AAV" and insert -- AAV --.

In Column 97, Line 4, delete "[AAV AAV" and insert -- [AAV --.

In Column 104, Line 36, delete "bylayers" and insert -- bilayers --.

In Column 104, Line 54, delete "adenovirous" and insert -- adenovirus --.

In Column 105, Line 19, delete "anti-HER-2-antibody(or" and insert -- anti-HER-2-antibody (or --.

CERTIFICATE OF CORRECTION (continued)
U.S. Pat. No. 11,384,344 B2

In Column 106, Line 41, delete "the a" and insert -- a --.

In Column 107, Lines 24-25, delete "disulfideto" and insert -- disulfide-to --.

In Column 107, Line 54, delete "perfluorated" and insert -- perfluorinated --.

In Column 108, Line 29, delete "Drosophilia" and insert -- Drosophila --.

In Column 114, Line 67, delete "Magniolales," and insert -- Magnoliales, --.

In Column 115, Line 1, delete "Aristochiales," and insert -- Aristolochiales, --.

In Column 115, Line 6, delete "Diapensales," and insert -- Dispensaries, --.

In Column 115, Line 17 (Approx.), delete "Eriocaulales," and insert -- Eriocaulaceae, --.

In Column 115, Line 37, delete "Aragrostis," and insert -- Eragrostis, --.

In Column 115, Line 39, delete "Heterocallis," and insert -- Hemerocallis, --.

In Column 115, Line 40, delete "Pannesetum," and insert -- Pennisetum, --.

In Column 115, Line 51, delete "Anikstrodesmis," and insert -- Ankistrodesmus, --.

In Column 115, Line 54, delete "Hematococcus," and insert -- Haematococcus, --.

In Column 115, Line 55, delete "Nannnochloropsis," and insert -- Nannochloropsis, --.

In Column 115, Line 55, delete "Nephrochloris," and insert -- Nephrosclerosis, --.

In Column 115, Line 56, delete "Oochromonas," and insert -- Ochromonas, --.

In Column 115, Line 57, delete "Oscillartoria," and insert -- Oscillatoria, --.

In Column 115, Lines 57-58, delete "Playtmonas," and insert -- Platymonas, --.

In Column 115, Line 58, delete "Porhyra," and insert -- Porphyra, --.

In Column 116, Line 65, delete "cerervisiae," and insert -- cerevisiae, --.

In Column 117, Line 40, delete "guideRNA" and insert -- guide RNA --.

In Column 125, Lines 26-27, delete "chlorosulfuron" and insert -- chlorsulfuron --.

In Column 130, Lines 24-25, delete "(Arabidopsmay" and insert -- (Arabidopsis may --.

CERTIFICATE OF CORRECTION (continued)
U.S. Pat. No. 11,384,344 B2

In Column 131, Line 57, delete "fawcetti," and insert -- fawcettii, --.

In Column 131, Line 62, delete "Phytophtora" and insert -- Phytophthora --.

In Column 131, Line 65, delete "Phytophtora" and insert -- Phytophthora --.

In Column 132, Line 2, delete "Uninula" and insert -- Uncinula --.

In Column 132, Line 4, delete "Gloesporium" and insert -- Gloeosporium --.

In Column 132, Line 5, delete "Mycosphaerela" and insert -- Mycosphaerella --.

In Column 132, Line 12, delete "Xanthomonas" and insert -- Xanthomonas; --.

In Column 132, Line 22, delete "casiicola," and insert -- cassiicola, --.

In Column 132, Line 24, delete "Colletrichum lindemthianum;" and insert -- Colletotrichum lindemuthianum; --.

In Column 132, Line 49, delete "debarianum," and insert -- debaryanum, --.

In Column 132, Line 53, delete "homeocarpa," and insert -- homoeocarpa, --.

In Column 132, Line 63, delete "Polymixa" and insert -- Polymyxa --.

In Column 133, Lines 9-10, delete "viridichromogenes)," and insert -- viridochromogenes), --.

In Column 133, Line 10, delete "proprionic" and insert -- propionic --.

In Column 133, Line 11, delete "cyclohexones" and insert -- cyclohexanones --.

In Column 133, Line 33, delete "occuring" and insert -- occurring --.

In Column 133, Line 50, delete "phosphorybosyltransferase" and insert -- phosphoribosyltransferase --.

In Column 133, Line 58, delete "WO99/58688," and insert -- WO 99/58688, --.

In Column 135, Line 29, delete "104004782)" and insert -- 104004782). --.

In Column 135, Line 46, delete "varieties" and insert -- varieties. --.

In Column 136, Line 53, delete "and or" and insert -- and/or --.

In Column 137, Line 36, delete "Kwolton," and insert -- Knowlton, --.

CERTIFICATE OF CORRECTION (continued)
U.S. Pat. No. 11,384,344 B2

In Column 137, Line 38, delete "2008)" and insert -- 2008). --.

In Column 137, Line 48, delete "125-143)," and insert -- 125-143). --.

In Column 138, Line 39, delete "Psylium" and insert -- Psyllium --.

In Column 139, Line 15, delete "scallon" and insert -- scallion --.

In Column 139, Line 52, delete "which which" and insert -- which --.

In Column 142, Line 14, delete "3-phospate deshydrogenase" and insert -- 3-phosphate dehydrogenase --.

In Column 142, Line 18, delete "phoshatidate" and insert -- phosphatidate --.

In Column 142, Line 19, delete "palmitoyi" and insert -- palmitoyl --.

In Column 142, Line 34, delete "cerevisae," and insert -- cerevisiae, --.

In Column 150, Line 3, delete "("FAEE")," and insert -- ("FAEE"). --.

In Column 150, Line 20, delete "diacylglycerl" and insert -- diacylglycerol --.

In Column 150, Line 23, delete "Alkaligenes" and insert -- Alcaligenes --.

In Column 150, Line 46, delete "Synechoystis," and insert -- Synechocystis, --.

In Column 150, Line 48-49, delete "Myceliophtora," and insert -- Myceliophthora, --.

In Column 150, Line 50, delete "Stenotrophamonas," and insert -- Stenotrophomonas, --.

In Column 161, Line 42-43, delete "telangictasia," and insert -- telangiectasia, --.

In Column 161, Line 47-48, delete "galactosemis," and insert -- galactosemia, --.

In Column 161, Line 52, delete "Klinefleter" and insert -- Klinefelter --.

In Column 161, Line 55, delete "insipdius," and insert -- insipidus, --.

In Column 163, Line 67, delete "interelukin" and insert -- interleukin --.

In Column 164, Line 3, delete "Diamon" and insert -- Diamond --.

In Column 164, Line 23-24, delete "galactercerebrosidease," and insert -- galactocerebrosidase, --.

In Column 166, Line 45, delete "Abetaiipoproteinemia," and insert -- Abetalipoproteinemia, --.

In Column 166, Line 48-49, delete "Meliitus," and insert -- Mellitus, --.

In Column 166, Line 50, delete "Hyperinsuiinism," and insert -- Hyperinsulinism, --.

In Column 166, Line 51, delete "Hypobetalipoproteinemias," and insert -- Hypobetalipoproteinemia, --.

In Column 167, Line 54, delete "Serpinal" and insert -- Serpina1 --.

In Column 167, Line 60-61, delete "Serpinal" and insert -- Serpina1 --.

In Column 171, Line 3, delete "hematopoetic" and insert -- hematopoietic --.

In Column 171, Line 7, delete "mucopolysaccharoidoses," and insert -- mucopolysaccharidosis, --.

In Column 171, Line 10, delete "β-thalessemia." and insert -- β-thalassemia. --.

In Column 172, Line 1, delete "synthease" and insert -- synthetase --.

In Column 172, Line 7, delete "(Lesch-Nynan" and insert -- (Lesch-Nyhan --.

In Column 172, Line 42-43, delete "Hyperlipidemias," and insert -- Hyperlipidemia, --.

In Column 173, Line 16, delete "orangiopoietin" and insert -- or angiopoietin --.

In Column 173, Line 43, delete "used/and or" and insert -- used and/or --.

In Column 174, Line 11, delete "combatting" and insert -- combating --.

In Column 176, Line 7, delete "used/and or" and insert -- used and/or --.

In Column 176, Line 9, delete "adenoassociated" and insert -- adeno associated --.

In Column 176, Line 25, delete "used/and or" and insert -- used and/or --.

In Column 176, Line 37, delete "Intraveinous" and insert -- Intravenous --.

In Column 176, Line 42, delete "about about" and insert -- about --.

In Column 180, Line 50, delete "Retinis-" and insert -- Retinitis- --.

In Column 181, Line 7, delete "Retinis-" and insert -- Retinitis- --.

In Column 182, Line 66, delete "Perpsectives" and insert -- Perspectives --.

In Column 191, Line 62-63, delete "Adrenoleukodystrophypa," and insert

CERTIFICATE OF CORRECTION (continued)
U.S. Pat. No. 11,384,344 B2

-- Adrenoleukodystrophy, --.

In Column 192, Line 20, delete "cyclophos-phamide." and insert -- cyclophosphamide. --.

In Column 199, Line 62, delete "used/and or" and insert -- used and/or --.

In Column 200, Line 24, delete "straiatum." and insert -- striatum. --.

In Column 200, Line 40, delete "isofluorane," and insert -- isoflurane, --.

In Column 203, Line 6, delete "apoplipoprotein" and insert -- apolipoprotein --.

In Column 204, Line 18, delete "apoplipoprotein" and insert -- apolipoprotein --.

In Column 204, Line 29, delete "as as" and insert -- as --.

In Column 204, Line 33, delete "apoplipoprotein" and insert -- apolipoprotein --.

In Column 207, Line 59, delete "amyotrophyic" and insert -- amyotrophic --.

In Column 209, Line 38-39, delete "phosphoribosylaminoimi dazole" and insert -- phosphoribosylaminoimidazole --.

In Column 211, Line 48-49, delete "benzodiazapine" and insert -- benzodiazepine --.

In Column 211, Line 66, delete "benzodiazapine" and insert -- benzodiazepine --.

In Column 218, Line 16, delete "ThermoFischer." and insert -- Thermo Fisher. --.

In Column 218, Line 37, delete "Choroidermia," and insert -- Choroideremia, --.

In Column 218, Line 40, delete "Leventinesse," and insert -- Leventinese, --.

In Column 219, Line 32, delete "endostain" and insert -- endostatin --.

In Column 219, Line 57, delete "used/and or" and insert -- used and/or --.

In Column 220, Line 59, delete "degeration" and insert -- degeneration --.

In Column 221, Line 45-46, delete "Hemicentrin" and insert -- Hemicentin --.

In Column 221, Line 51, delete "1(PROM1" and insert -- 1 (PROM1 --.

In Column 232, Line 10 (Approx.), delete "streptozotocininjected" and insert -- streptozotocin injected --.

CERTIFICATE OF CORRECTION (continued)
U.S. Pat. No. 11,384,344 B2

In Column 233-234 (TABLE 7), Line 12 (Approx.), delete "Streptozotozin-" and insert -- Streptozotocin- --.

In Column 235-236 (TABLE 7-continued), Line 28 (Approx.), delete "citotoxicity," and insert -- cytotoxicity, --.

In Column 237, Line 19, delete "Hemophillia" and insert -- Hemophilia --.

In Column 248, Line 38-39, delete "immunoreponsive" and insert -- immunoresponsive --.

In Column 256, Line 17, delete "amd" and insert -- and --.

In Column 257-258 (TABLE 9), Line 11, delete "Leukocyde" and insert -- Leukocyte --.

In Column 277, Line 2, delete "aminomethan)" and insert -- aminomethane) --.

In Column 277, Line 28, delete "Statemetns" and insert -- Statements --.

In Column 277, Line 34, delete "Statemetns" and insert -- Statements --.

In Column 277, Line 37, delete "Statemetns" and insert -- Statements --.

In Column 277, Line 41, delete "Statemetns" and insert -- Statements --.

In Column 277, Line 43, delete "Statemetns" and insert -- Statements --.

In Column 277, Line 46, delete "Statemetns" and insert -- Statements --.

In Column 277, Line 49, delete "Statemetns" and insert -- Statements --.

In Column 277, Line 52, delete "Statemetns" and insert -- Statements --.

In Column 277, Line 55, delete "Statemetns" and insert -- Statements --.

In Column 303, Line 21-22, delete "(ThermoFisher)" and insert -- (Thermo Fisher) --.

In Column 303, Line 25, delete "(ThermoFisher)." and insert -- (Thermo Fisher). --.

In Column 316, Line 47, delete "Coomassiestained" and insert -- Coomassie stained --.

In Column 317, Line 12 (Approx.), delete "donor" and insert -- donor. --.

In Column 317, Line 34, delete "chloerae." and insert -- cholerae. --.

In Column 317, Line 60, delete "sgRNA" and insert -- sgRNA. --.

CERTIFICATE OF CORRECTION (continued)
U.S. Pat. No. 11,384,344 B2

In Column 325, Lines 7-8, delete "(ThermoFisher)" and insert -- (Thermo Fisher) --.

In Column 325, Line 11, delete "(ThermoFisher)." and insert -- (Thermo Fisher). --.